United States Patent
Singh et al.

(10) Patent No.: US 10,905,061 B2
(45) Date of Patent: Feb. 2, 2021

(54) MADS-BOX DOMAIN ALLELES FOR CONTROLLING SHELL PHENOTYPE IN PALM

(71) Applicant: Malaysian Palm Oil Board, Selangor (MY)

(72) Inventors: Rajinder Singh, Kuala Lumpur (MY); Leslie Low Eng Ti, Kuala Lumpur (MY); Leslie Ooi Cheng Li, Kuala Lumpur (MY); Meilina Ong Abdullah, Seremban (MY); Rajanaidu Nookiah, Kuala Lumpur (MY); Ravigadevi Sambanthamurthi, Selangor (MY); Andrew Van Brunt, St. Louis, MO (US); Muhammad A. Budiman, St. Louis, MO (US); Steven W. Smith, Fitchburg, WI (US); Nathan D. Lakey, Chesterfield, MO (US); Rob Martienssen, Cold Spring Harbor, NY (US); Jared Ordway, St. Louis, MO (US)

(73) Assignee: Malaysian Palm Oil Board, Selangor (MY)

( * ) Notice: Subject to any disclaimer, the term of this patent is extended or adjusted under 35 U.S.C. 154(b) by 158 days.

(21) Appl. No.: 15/580,645

(22) PCT Filed: Jun. 14, 2016

(86) PCT No.: PCT/US2016/037429
§ 371 (c)(1),
(2) Date: Dec. 7, 2017

(87) PCT Pub. No.: WO2016/205240
PCT Pub. Date: Dec. 22, 2016

(65) Prior Publication Data
US 2018/0160639 A1    Jun. 14, 2018

Related U.S. Application Data

(60) Provisional application No. 62/180,042, filed on Jun. 15, 2015.

(51) Int. Cl.
| | |
|---|---|
| *A01H 1/04* | (2006.01) |
| *C12Q 1/6895* | (2018.01) |
| *A01H 5/08* | (2018.01) |
| *C07K 14/415* | (2006.01) |
| *C12N 15/82* | (2006.01) |
| *A01H 5/10* | (2018.01) |

(52) U.S. Cl.
CPC ............ *A01H 1/04* (2013.01); *A01H 5/08* (2013.01); *A01H 5/10* (2013.01); *C07K 14/415* (2013.01); *C12N 15/8261* (2013.01); *C12Q 1/6895* (2013.01); *C12Q 2600/13* (2013.01); *C12Q 2600/156* (2013.01); *Y02A 40/146* (2018.01)

(58) Field of Classification Search
None
See application file for complete search history.

(56) References Cited

U.S. PATENT DOCUMENTS

| | | | |
|---|---|---|---|
| 2010/0286068 A1 | 11/2010 | Abdullah et al. | |
| 2013/0247249 A1* | 9/2013 | Singh ................ | C12N 15/8261 800/290 |
| 2015/0024388 A1 | 1/2015 | Singh et al. | |

FOREIGN PATENT DOCUMENTS

WO      2015010008 A1      1/2015

OTHER PUBLICATIONS

Barcelos et al. (Aug. 2002, "Genetic Diversity and Relationship in American and African Oil Palm as Revealed by RFLP and AFLP Molecular Markers", Pesquisa Agropecuaria Brasília, 37(8):1105-1114).*
Extended European Search Report from EP Application No. 16812254 completed on Oct. 12, 2018.
Billotte, N., et al., "Microsatellite-Based High Density Linkage Map in Oil Palm (*Elaeis guineensis* Jacq.)" Theor Appl Genet (2005) 110: 754-765.
Mayes, S, et al., "Construction of a RFLP Genetic Linkage Map for Oil Palm (*Elaeis guineensis* Jacq.)" Genome, vol. 40, 1997, pp. 116-122.
Singh, R., et al., "Development of Simple Sequence Repeat (SSR) Markers for Oil Palm and Their Application in Genetic Mapping and Fingerprinting of Tissue Culture Clones" Asia Pacific Journal of Molecular Biology and Biotechnology, 2007, vol. 15 (3):pp. 121-131.
PCT/US2016/037429 , "International Search Report and Written Opinion", dated Mar. 13, 2017, 17 pages.
Singh et al., "The oil palm Shell gene controls oil yield and encodes a homologue of SEEDSTICK", Nature, Aug. 15, 2013, 500(7462):340-344.
CONC2018/0000194 , "Office Action", dated Jan. 15, 2018, 2 pages.
CONC2018/0000194 , "Office Action", dated Feb. 26, 2020, 9 pages.
IDP00201708995 , "Substantive Examination Report", dated Jan. 17, 2020, 5 pages.

* cited by examiner

*Primary Examiner* — Stuart F Baum
(74) *Attorney, Agent, or Firm* — Kilpatrick Townsend & Stockton LLP

(57) ABSTRACT

Nucleic acid and polypeptide sequences for predicting and controlling shell phenotype in palm.

18 Claims, 3 Drawing Sheets
Specification includes a Sequence Listing.

MADS-BOX DOMAIN ALLELES FOR CONTROLLING SHELL PHENOTYPE IN PALM

CROSS-REFERENCES TO RELATED APPLICATIONS

This application is a U.S. National Stage Entry under 35 U.S.C. § 371 of PCT International Application No. PCT/US2016/037429, filed Jun. 14, 2016, which claims priority to U.S. Provisional Application No. 62/180,042, filed Jun. 15, 2015, the contents of which are hereby incorporated by reference in its entirety for all purposes.

REFERENCE TO SEQUENCE LISTING

This application includes a Sequence Listing as a text file named "096380-1068853-000610US-SEQLIST.txt" created Dec. 6, 2017, and containing 4,456,586 bytes. The material contained in this text file is incorporated by reference in its entirety for all purposes.

BACKGROUND OF THE INVENTION

The oil palm (*E. guineensis* and *E. oleifera*) can be classified into separate groups based on its fruit characteristics, and has three naturally occurring fruit types which vary in shell thickness and oil yield. *Dura* type palms are homozygous for a wild type allele of the shell gene ($sh^+/sh^+$), have a thick seed coat or shell (2-8 mm) and produce approximately 5.3 tons of oil per hectare per year. *Tenera* type palms are heterozygous for a wild type and mutant allele of the shell gene ($sh^+/sh^-$), have a relatively thin shell surrounded by a distinct fiber ring, and produce approximately 7.4 tons of oil per hectare per year. Finally, *pisifera* type palms are homozygous for a mutant allele of the shell gene ($sh^-/sh^-$), have no seed coat or shell, and are usually female sterile (Hartley, 1988) (Table 1). Therefore, the inheritance of the single gene controlling shell phenotype is a major contributor to palm oil yield.

*Tenera* palms are hybrids between the *dura* and *pisifera* palms. Whitmore (1973) described the various fruit forms as different varieties of oil palm. However, Latiff (2000) was in agreement with Purseglove (1972) that varieties or cultivars as proposed by Whitmore (1973), do not occur in the strict sense in this species. As such, Latiff (2000) proposed the term "race" to differentiate *dura*, *pisifera* and *tenera*. Race was considered an appropriate term as it reflects a permanent microspecies, where the different races are capable of exchanging genes with one another, which has been adequately demonstrated in the different fruit forms observed in oil palm (Latiff, 2000). In fact, the characteristics of the three different races turn out to be controlled simply by the inheritance of a single gene. Genetic studies revealed that the shell gene shows co-dominant monogenic inheritance, which is exploitable in breeding programmes (Beirnaert and Vanderweyen, 1941).

The shell gene responsible for this phenotype was first reported in the Belgian Congo in the 1940's (Beirnaert and Venderweyan, 1941). However, *tenera* fruit forms were recognized and exploited in Africa well before then (Devuyst, 1953; Godding, 1930; Sousa et al., 2011). Given the central role played by the shell gene, oil palm breeding utilizes reciprocal recurrent selection of maternal (*dura*) and paternal (*pisifera*) pools using the North Carolina Model 1 maize breeding design (Rajanaidu et al., 2000). The Deli *dura* population, direct descendants of the four original African palms planted in Bogor Botanical Garden, Indonesia (1848), has excellent combining ability with the AVROS (Algemene Vereniging van Rubberplanters ter Oostkust van Sumatra) and other *pisifera* parental palms. AVROS *pisifera* palms were derived from the famous "Djongo" palm from Congo, but more recently several different accessions of *dura* and *pisifera* have also been sourced from Africa (Rajanaidu et al., 2000).

*Tenera* fruit types have a higher mesocarp to fruit ratio, which directly translates to significantly higher oil yield than either the *dura* or *pisifera* palm (as illustrated in Table 1).

TABLE 1

Comparison of dura, tenera and *pisifera* fruit forms

| | Fruit Form | | |
|---|---|---|---|
| Characteristic | Dura | Tenera | Pisifera* |
| Shell thickness (mm) | 2-8 | 0.5-3 | Absence of shell |
| Fibre Ring ** | Absent | Present | Absent |
| Mesocarp Content (% fruit weight) | 35-55 | 60-96 | 95 |
| Kernel Content (% fruit weight) | 7-20 | 3-15 | 3-5 |
| Oil to Bunch (%) | 16 | 26 | — |
| Oil Yield (t/ha/yr) | 5.3 | 7.4 | — |

*usually female sterile, bunches rot prematurely
** fibre ring is present in the mesocarp and often used as diagnostic tool to differentiate dura and tenera palms.
(Source: Hardon et al., 1985; Hartley, 1988)

Since the crux of the breeding programmes in oil palm is to produce planting materials with higher oil yield, the *tenera* palm is the preferred choice for commercial planting. It is for this reason that substantial resources are invested by commercial seed producers to cross selected *dura* and *pisifera* palms in hybrid seed production. And despite the many advances which have been made in the production of hybrid oil palm seeds, two significant problems remain in the seed production process. First, batches of *tenera* seeds, which will produce the high oil yield *tenera* type palm, are often contaminated with *dura* seeds (Donough and Law, 1995). Today, it is estimated that *dura* contamination of *tenera* seeds can reach rates of approximately 5% (reduced from as high as 20-30% in the early 1990's as the result of improved quality control practices). Seed contamination is due in part to the difficulties of producing pure *tenera* seeds in open plantation conditions, where workers use ladders to manually pollinate tall trees, and where palm flowers for a given bunch mature over a period time, making it difficult to pollinate all flowers in a bunch with a single manual pollination event. Some flowers of the bunch may have matured prior to manual pollination and therefore may have had the opportunity to be wind pollinated from an unknown tree, thereby producing contaminant seeds in the bunch. Alternatively premature flowers may exist in the bunch at the time of manual pollination, and may mature after the pollination occurred allowing them to be wind pollinated from an unknown tree thereby producing contaminant seeds in the bunch. Prior to the invention described herein, it was not possible to identify the fruit type of a given seed or a given plant arising from a seed until the plant matured enough to produce a first batch of fruit, which typically takes approximately six years after germination. Notably, in the four to five years interval from germination to fruit production, significant land, labor, financial and energy resources are invested into what are believed to be *tenera* trees, some of which will ultimately be of the unwanted low yielding contaminant fruit types. By the time these suboptimal trees are identified, it is impractical to remove them from the field and replace them with *tenera* trees, and thus growers achieve lower palm oil yields for the 25 to 30 year production life of the contaminant trees. Therefore, the issue of contamination of batches of *tenera* seeds with *dura* or *pisifera* seeds is a problem for oil palm breeding, underscoring the need for a method to predict the fruit type of seeds and nursery plantlets with high accuracy.

A second problem in the seed production process is the investment seed producers make in maintaining *dura* and *pisifera* lines, and in the other expenses incurred in the hybrid seed production process. Traditionally, there was no know way to produce a tree with an optimal shell phenotype which when crossed to itself or to another tree with optimal shell phenotype would produce seeds which would only generate optimal shell phenotypes. Therefore, there is a need to engineer trees to breed true from one generation to the next for optimal shell phenotype. There is also a need to separate predicted *tenera* plants (e.g., seeds or seedlings) from any contaminating *dura* and/or *pisifera* plants produced during the the hybrid production process. Similarly, there is a need to separate predicted *dura* plants from *pisifera* and/or *tenera* plants and predicted *pisifera* plants from *dura* and/or *tenera* plants to maintain breeding stocks for hybrid production.

The genetic mapping of the SHELL gene was initially attempted by Mayes et al. (1997). A second group in Brazil, using a combination of bulked segregation analysis (BSA) and genetic mapping, reported two random amplified polymorphic DNA (RAPD) markers flanking the shell locus (Moretzsohn et al., 2000). More recently, Billotte et al., (2005) reported a simple sequence repeat (SSR)-based high density linkage map for oil palm, involving a cross between a thin shelled *E. guineensis* (*tenera*) palm and a thick shelled *E. guineensis* (*dura*) palm. A patent application filed by the Malaysian Palm Oil Board (MPOB) describes the identification of a marker using restriction fragment technology, in particular a Restriction Fragment Length Polymorphism (RFLP) marker linked to the shell gene for plant identification and breeding purposes (RAJINDER SINGH, LESLIE OOI CHENG-LI, RAHIMAH A. RAHMAN AND LESLIE LOW ENG TI. 2008. Method for identification of a molecular marker linked to the shell gene of oil palm. Patent Application No. PI 20084563. Patent Filed on 13 Nov. 2008). The RFLP marker (SFB 83) was identified by way of generation or construction of a genetic map for a *tenera* fruit type palm. The patent application publications U.S. 2013/024729 and U.S. 2015/0037793, filed by MPOB, describe the identification of the SHELL gene, two *pisifera* alleles ($sh^{AVROS}$ and $sh^{MPOB}$) and methods for predicting fruit form phenotype by detecting wild-type and *pisifera* alleles of the SHELL gene.

BRIEF SUMMARY OF THE INVENTION

Here we describe the identification of novel alleles of the SHELL gene responsible for different fruit form phenotypes and methods for predicting or determining the shell phenotype of a palm plant (including but not limited to a whole palm plant or palm seed). The SHELL gene is an oil palm MADS-box gene substantially similar to *Arabidopsis* SEEDSTICK (STK), also referred to as AGAMOUS-like 11 (AGL11), as well as to *Arabidopsis* SHATTERPROOF (SHP1), also referred to as AGAMOUS-like 1 (AGL1).

Two SHELL alleles, $sh^{MPOB}$ and $sh^{AVROS}$, have been previously identified either of which result in the preferred *tenera* fruit form when present in an oil palm having one copy of a mutant allele and one wild-type allele. For example, heterozygous oil palms including the wildtype SHELL allele, $Sh^{DeliDura}$, on one chromosome and either of the two mutant SHELL alleles on the other chromosome exhibit a *tenera* phenotype.

Described herein are nine additional mutations in exon one of the SHELL gene, referred to as SHELL alleles three (3), four (4), five (5), six (6), seven (7), eight (8), nine (9), ten (10), and eleven (11). The amino acid sequences of the SHELL gene product resulting from alleles 3-11 are depicted in SEQ ID NOs:3-11 respectively. The nucleotide sequences for exon 1 of the SHELL gene for alleles 3-11 are depicted in SEQ ID NOs:13-21 respectively. As with the $sh^{MPOB}$ and $sh^{AVROS}$ alleles, the presence of these SHELL alleles can result in a *tenera* phenotype when heterozygous with a wild-type allele or a *pisifera* phenotype when either homozygous, or heterozygous with another non-functional SHELL allele.

In reference to the wild-type SHELL ($Sh^{DeliDura}$) gene, the allele 3 polymorphism is an adenosine to cytosine (A→C) mutation at nucleotide position 67 of exon 1 of the SHELL gene. Allele 3 results in a lysine to glutamine substitution within the conserved MADS box domain of SHELL. As diagrammed in FIG. 1, the entire MADS box domain of SHELL is encoded by exon 1 of the SHELL gene. The variant amino acid occurs 6 amino acids N-terminal to the amino acid substitution arising from the $sh^{MPOB}$ allele, 8 amino acids N-terminal to the amino acid substitution arising from the $sh^{AVROS}$ allele, and at position 23 of the translated open reading frame of exon 1 (FIGS. 2 and 3).

Similarly, the allele 4 polymorphism is a cytosine to adenosine (C→A) mutation at nucleotide position 122 of exon 1 of the SHELL gene. Allele 4 results in an alanine to aspartate substitution within the conserved MADS box domain of SHELL. The variant amino acid occurs at position 41 of the translated open reading frame of exon 1 (FIGS. 2 and 3).

The allele 5 polymorphism is an adenosine to thymine (A→T) mutation at nucleotide position 69 of exon 1 of the SHELL gene. Allele 5 results in a lysine to asparagine mutation at position 23 of the translated open reading frame of exon 1 (FIGS. 2 and 3). The allele 6 polymorphism is a guanosine to cytosine (G→C) mutation at position 34 of exon 1 of the SHELL gene. Allele 6 results in a glutamate to glutamine mutation at position 12 of the translated open reading frame of exon 1 (FIGS. 2 and 3). The allele 7 polymorphism is a deletion of fifteen nucleotides at positions 23-37 of exon 1 of the SHELL gene (or nucleotides 22-36 because alignment of the gap is ambiguous). Allele 7 results in an in frame deletion of five amino acids at positions 8 to 12 of the translated open reading frame of exon 1 (FIGS. 2 and 3). Amino acid positions 8 to 12 of the SHELL gene are encoded by nucleotides 22-36. The allele 8 polymorphism is a guanosine to adenosine (G→A) mutation at position 71 of exon 1 of the SHELL gene. Allele 8 results in an arginine to histidine mutation at position 24 of the translated open reading frame of exon 1 (FIGS. 2 and 3).

The allele 9 polymorphism is a cytosine to guanosine (C→G) mutation at position 70 of exon 1 of the SHELL gene. Allele 9 results in an arginine to glycine mutation at position 24 of the translated open reading frame of exon 1. The allele 10 polymorphism is a thymine to adenosine (T→A) mutation at position 110 of exon 1 of the SHELL gene. Allele 10 results in a valine to aspartate mutation at position 37 of the translated open reading frame of exon 1 (FIGS. 2 and 3).

The allele 11 polymorphism is a thymine to cytosine (T→C) mutation at position 114 of exon 1 of the SHELL gene. Allele 11 is a silent mutation in that it does not affect the resulting amino acid sequence of the SHELL gene product (FIGS. 2 and 3). This mutation can be detected to confirm or predict the presence or absence of a wildtype SHELL gene product and therefore predict a *dura* phenotype when homozygous or heterozygous with another wildtype allele in a palm plant and a *tenera* phenotype when heterozygous with an inactive SHELL allele. Alternatively, in some embodiments this mutation can affect gene expression and/or transcriptional or translational regulation of the SHELL gene. Accordingly in such embodiments, the mutation can correlate with a *pisifera* when homozygous or heterozygous with an inactive SHELL allele in a palm plant or *tenera* when heterozygous with a wildtype allele.

Also described herein is a mutation in intron 1 of the SHELL gene that has been discovered in a subset of oil palm plants having the allele 3 mutation. This mutation is referred to herein as allele 12 and depicted in SEQ ID NO:12. The mutation results in deletion of four nucleotides at positions 43-46 of intron 1 of the wild-type SHELL ($Sh^{DeliDura}$) gene. The mutation may be silent in that it may not by itself contribute to the presence or absence of a SHELL fruit form phenotype (e.g., *dura, tenera,* or *pisifera*). However, due to the close physical distance (i.e., genetic linkage) between the intron 1 mutation and exon 1, the contribution of parental germ plasm known to have a particular SHELL allele (wild-type or mutant) within exon 1 and the intron 1 marker can be tracked with a high degree of confidence in progeny by detection of the allele 12 mutation rather than a mutation in exon 1. Moreover, in some cases, the mutation in intron 1 may be in linkage disequilibrium with exon 1 or a portion thereof. Alternatively, allele 12 may alter transcriptional regulation or splicing and thus exhibit a *pisifera* SHELL phenotype when homozygous or a *tenera* phenotype when heterozygous with a wildtype SHELL allele.

Nuclear proteins, such as transcription factors, must be actively transported into and retained within the nucleus to be functional. The nuclear localization mechanism involves the binding of nuclear localization protein signals in the nuclear protein to importin α and importin β subunits in the cytoplasm. Importin α binds to the nuclear localization signal (NLS), while importin β interacts with importin α as well as the nuclear pore. In plant MADS box proteins, the prominent NLS amino acid motif is KR[K or R]X₄KK (SEQ ID NO:29), where X can be any amino acid (Gramzow and Theissen, 2010). The SHELL MADS box domain includes this motif (KRRNGLLKK; SEQ ID NO:30) at amino acids 23-31. MADS box proteins may also have a bipartite NLS which that involves additional upstream amino acids. An example is the bipartite NLS of *petunia* FLORAL BINDING PROTEIN 11 (FBP11) which includes the sequence MGRGKIEIKRIENNTNRQVTFCKRRNGLLKK (SEQ ID NO:31). The bipartite NLS is made up of NLS amino acids (underlined), as well as conserved basic amino acids (italicized), all of which contribute to the nuclear localization mechanism (Immink et al., 2002).

The SHELL MADS box domain includes a very similar bipartite NLS including amino acids 3, 5, 9-10, and 21-31 (MGRGKIEIKRIENTTSRQVTFCKRRNGLLKK; SEQ ID NO:32) (FIGS. 2 and 3). It is noteworthy that of the ten sequence changes resulting in amino acid substitutions or deletions reported here ($sh^{AVROS}$, $sh^{MPOB}$, and alleles 3-10), six change one or more of these highly conserved NLS amino acids ($sh^{AVROS}$, shMPOB, allele 3, allele 5, allele 7, allele 8 and allele 9), and a 7$^{th}$ ($sh^{MPOB}$) introduces a proline substitution at a variable position within the prominent NLS that would be expected to significantly alter the secondary structure of the protein within the NLS domain (FIGS. 2 and 3). These findings suggest that a common mechanism imparting the *pisifera* (when homozygous or heterozygous with another nonfunctional SHELL allele) or *tenera* (when heterozygous with a wildtype SHELL allele) phenotype may be the reduction or prevention of the nuclear localization of nonfunctional SHELL proteins or dimers of SHELL proteins with other MADS box transcription factors. Therefore, it is likely that mutation of any of the conserved NLS amino acids (boxed in FIGS. 2 and 3), or any mutation that disrupted SHELL NLS function, can be associated with the *pisifera* or *tenera* phenotype.

Accordingly in one aspect, methods for determining or predicting the shell phenotype of a palm (e.g., oil palm) plant (including but not limited to a whole palm plant or palm seed) are provided. In some embodiments, the method comprises, providing a sample from the plant or seed; and determining from the sample the genotype of a polymorphic marker at a position in exon 1 of the SHELL gene selected from the group consisting of nucleotides:

(i) 7, 8, 9, 13, 14, 15, 22, 23, 24, 25, 26, 27, 28, 29, 30, 31, 32, 33, 34, 35, 36, 37, 61, 62, 63, 64, 65, 66, 67, 68, 69, 70, 71, 72, 73, 74, 75, 76, 77, 78, 79, 80, 81, 82, 83, 84, 85, 87, 88, 89, 90, 91, 92, 109, 110, 111, 114, 121, 122, and 123;

(ii) 23, 24, 25, 26, 27, 28, 29, 30, 31, 32, 33, 34, 35, 36, 37, 67, 69, 70, 71, 110, 114, and 122; or (iii) 7-9, 13-15, 25-30, 61-75 and 88-92. In some cases, heterozygosity at one or more of the polymorphic markers for a *pisifera* and a *dura* allele predicts the presence of the *tenera* shell phenotype. In some cases, homozygosity for a genotype of a predicted *pisifera* allele at one or more of the polymorphic markers predicts the presence of the *pisifera* shell phenotype. In some cases, the genotype of the polymorphic marker can comprise one or more of the predicted *pisifera* allele genotypes depicted in SEQ ID NOs: 13-21.

In some cases, a mutation with respect to the wild-type SHELL ($Sh^{DeliDura}$) gene at one or more of the nucleotide positions that results in an amino acid substitution (e.g., non-conservative substitution), deletion, insertion, or frameshift can predict a *pisifera* phenotype when homozygous or heterozygous with a different mutation with respect to the wild-type SHELL ($Sh^{DeliDura}$) gene, or a *tenera* phenotype when heterozygous with respect to the wild-type allele. For example, a mutation with respect to the wild-type SHELL ($Sh^{DeliDura}$) gene at one or more of the nucleotide positions that results in an amino acid substitution (e.g., non-conservative substitution), deletion, insertion, or frameshift can predict a *pisifera* phenotype when heterozygous with a different mutation that results in a non-functional SHELL gene, such as a mutation that results in a different substitution (e.g., non-conservative substitution), deletion, insertion, or frameshift.

In some embodiments, the genotype of the polymorphic marker comprises a deletion or mutation of one or more nucleotides selected from the group consisting of nucleotides: (i) 22, 23, 24, 25, 26, 27, 28, 29, 30, 31, 32, 33, 34, 35, 36, and 37; (ii) 22, 23, 24, 25, 26, 27, 28, 29, 30, 31, 32, 33, 34, 35, and 36; or (iii) 23, 24, 25, 26, 27, 28, 29, 30, 31, 32, 33, 34, 35, 36, and 37, of exon 1 of the SHELL gene. In some embodiments, the genotype of the polymorphic marker comprises a deletion of one or more, or all, of nucleotides 23-37 (or 22-36) of exon 1 of the SHELL gene. In some embodiments, the genotype of the polymorphic marker comprises a mutation of nucleotide 34 of exon 1 of the SHELL gene (e.g., a mutation relative to $Sh^{DeliDura}$). In some embodiments, the mutation comprises a missense (e.g., non-conservative substitution), nonsense, insertion, deletion, or frameshift mutation. In some embodiments, the genotype of the polymorphic marker comprises a cytosine (C) at nucleotide 34 of exon 1 of the SHELL gene.

In some embodiments, the genotype of the polymorphic marker comprises a mutation of nucleotide 67 of exon 1 of the SHELL gene (e.g., a mutation relative to $Sh^{DeliDura}$). In some embodiments, the mutation comprises a missense (e.g., non-conservative substitution), nonsense, insertion, deletion, or frameshift mutation. In some embodiments, the genotype of the polymorphic marker comprises a cytosine (C) at nucleotide 67 of exon 1 of the SHELL gene. In some embodiments, the genotype of the polymorphic marker comprises a mutation of nucleotide 69 of exon 1 of the SHELL gene (e.g., a mutation relative to $Sh^{DeliDura}$). In some embodiments, the mutation comprises a missense (e.g., non-conservative substitution), nonsense, insertion, deletion, or frameshift mutation. In some embodiments, the genotype of the polymorphic marker comprises a thymine (T) at nucleotide 69 of exon 1 of the SHELL gene.

In some embodiments, the genotype of the polymorphic marker comprises a mutation of nucleotide 70 of exon 1 of the SHELL gene (e.g., a mutation relative to $Sh^{DeliDura}$). In some embodiments, the mutation comprises a missense (e.g., non-conservative substitution), nonsense, insertion, deletion, or frameshift mutation. In some embodiments, the genotype of the polymorphic marker comprises a guanosine (G) at nucleotide 70 of exon 1 of the SHELL gene. In some embodiments, the genotype of the polymorphic marker comprises a mutation of nucleotide 71 of exon 1 of the SHELL gene (e.g., a mutation relative to $Sh^{DeliDura}$). In some embodiments, the mutation comprises a missense (e.g., non-conservative substitution), nonsense, insertion, deletion, or frameshift mutation. In some embodiments, the genotype of the polymorphic marker comprises an adenosine (A) at nucleotide 71 of exon 1 of the SHELL gene. In some embodiments, the genotype of the polymorphic marker comprises a mutation of nucleotide 110 of exon 1 of the SHELL gene (e.g., a mutation relative to $Sh^{DeliDura}$). In some embodiments, the mutation comprises a missense (e.g., non-conservative substitution), nonsense, insertion, deletion, or frameshift mutation. In some embodiments, the genotype of the polymorphic marker comprises an adenosine (A) at nucleotide 110 of exon 1 of the SHELL gene.

In some embodiments, the genotype of the polymorphic marker comprises a mutation of nucleotide 114 of exon 1 of the SHELL gene (e.g., a mutation relative to $Sh^{DeliDura}$). In some embodiments, the mutation comprises a missense (e.g., non-conservative substitution), nonsense, insertion, deletion, or frameshift mutation. In some embodiments, the genotype of the polymorphic marker comprises a cytosine (C) at nucleotide 114 of exon 1 of the SHELL gene. In some embodiments, the genotype of the polymorphic marker comprises a mutation of nucleotide 122 of exon 1 of the SHELL gene (e.g., a mutation relative to $Sh^{DeliDura}$). In some embodiments, the mutation comprises a missense (e.g., non-conservative substitution), nonsense, insertion, deletion, or frameshift mutation. In some embodiments, the genotype of the polymorphic marker comprises an adenosine (A) at nucleotide 122 of exon 1 of the SHELL gene.

In any one of the foregoing embodiments, the method can comprise, providing a sample from the plant or seed; and determining from the sample the genotype of a polymorphic marker at a position in exon 1 of the SHELL gene selected from the group consisting of nucleotides:

(i) 22, 23, 24, 25, 26, 27, 28, 29, 30, 31, 32, 33, 34, 35, 36, 37, 67, 68, 69, 70, 71, 72, 73, 74, 75, 76, 77, 78, 79, 80, 81, 82, 83, 84, 85, 87, 88, 89, 90, 91, 92, 110, 114, and 122;

(ii) 23, 24, 25, 26, 27, 28, 29, 30, 31, 32, 33, 34, 35, 36, 37, 67, 69, 70, 71, 110, 114, and 122; or (iii) 67, 69, 70, and 71. In some cases, heterozygosity at one or more of the polymorphic markers for a pisifera and a dura allele predicts the presence of the tenera shell phenotype. In some cases, homozygosity for a genotype of a predicted pisifera allele at one or more of the polymorphic markers predicts the presence of the pisifera shell phenotype. In some cases, heterozygosity for a genotype of a first predicted pisifera allele at one or more of the polymorphic markers and a second predicted pisifera allele at one or more of the polymorphic markers predicts the presence of the pisifera shell phenotype. In some cases, the genotype of the polymorphic marker can comprise one or more of the predicted pisifera allele genotypes depicted in SEQ ID NOs:13, 15, 17, 18, and 19.

In some embodiments, the method comprises, providing a sample from the plant or seed; and determining from the sample the genotype of a polymorphic marker at a position in intron 1 of the SHELL gene selected from the group consisting of nucleotides 43, 44, 45, and 46. In some cases, heterozygosity at one or more of the polymorphic markers for a pisifera and a dura allele predicts the presence of the tenera shell phenotype. In some cases, homozygosity for a genotype of a predicted pisifera allele at one or more of the polymorphic markers predicts the presence of the pisifera shell phenotype. In some cases, heterozygosity for a genotype of a first predicted pisifera allele at one or more of the polymorphic markers and a genotype of a second predicted pisifera allele at one or more of the polymorphic markers predicts the presence of the pisifera shell phenotype. In some cases, the genotype of the polymorphic marker can comprise one or more, or all, of the deleted of the nucleotides of intron 1 depicted in SEQ ID NO:12.

In some embodiments, the method comprises, providing a sample from the plant or seed; and detecting in the sample a genotype of a polymorphic marker that encodes for a mutation in the SHELL gene product at one or more amino acid positions selected from the group consisting of amino acid positions 3, 5, 8, 9, 10, 11, 12, 21, 22, 23, 24, 25, 26, 27, 28, 30, 37, and 4, 1 selected from the group consisting of amino acid positions 3, 5, 8, 9, 10, 11, 12, 21, 22, 23, 24, 25, 26, 27, 28, 30, 31, 37, and 41, selected from the group consisting of amino acid positions 8, 9, 10, 11, 12, 23, 24, 37, and 41 or selected from the group consisting of amino acid positions 8, 9, 10, 11, 12, 23, 24, 31, 37, and 41. In some cases, the genotype of the polymorphic marker comprises a deletion of one or more, or all, of the amino acids at positions 8-12 of the wildtype SHELL gene product. In some cases, heterozygosity at one or more of the polymorphic markers for a pisifera and a dura allele predicts the presence of the tenera shell phenotype. In some cases, homozygosity for a genotype of a predicted pisifera allele at one or more of the polymorphic markers predicts the presence of the pisifera shell phenotype. In some cases, heterozygosity for a genotype of a first predicted pisifera allele at one or more of the polymorphic markers and a second predicted pisifera allele at one or more of the polymorphic markers predicts the presence of the pisifera shell phenotype. In some cases, the genotype of the polymorphic marker can comprise one or more of the predicted pisifera allele SHELL gene products depicted in SEQ ID NOs:3-10, or one or more of the predicted pisifera allele SHELL gene products depicted in SEQ ID NOs:3, 5, 7, 8, and 9.

In some embodiments, the genotype of the polymorphic marker comprises a mutation at amino acid position 23 as compared to the wildtype SHELL gene product. In some cases, the mutation comprises a lysine to glutamine or a lysine to asparagine mutation at amino acid position 23. In some embodiments, the genotype of the polymorphic marker comprises a mutation at amino acid position 24 as compared to the wildtype SHELL gene product. In some cases, the mutation comprises an arginine to histidine or an arginine to glycine mutation at amino acid position 24. In some embodiments, the genotype of the polymorphic maker comprises a mutation at amino acid position 37 of the wildtype SHELL gene product. In some cases, the mutation comprises a valine to aspartate mutation at amino acid 37. In some embodiments, the genotype of the polymorphic marker comprises a mutation at amino acid position 41 of the wildtype SHELL gene product. In some cases, the mutation comprises an alanine to aspartate mutation at amino acid 41.

In some embodiments, the method comprises, providing a sample from the plant or seed; and detecting in the sample a genotype of a polymorphic marker that encodes for a mutation in the SHELL gene product at a position in the nuclear localization signal (NLS) of the SHELL gene product, wherein the mutation at the position in the NLS comprises a mutation at an amino acid position selected from the group consisting of amino acid position 3, 5, 9, 10, 21, 22, 23, 24, 25, 26, 27, 28, and 30; or amino acid position 23, 24, 25, 26, 27, 28, and 30 of the SHELL gene product. In some cases, the mutation is at an amino acid position selected from the group consisting of amino acid position 23 and 24 of the SHELL gene product. In some cases, the mutation at amino acid position 23 comprises a lysine to glutamine mutation. In some cases, the mutation at amino acid position 23 comprises a lysine to asparagine mutation. In some cases, the mutation at amino acid position 24 comprises an arginine to histidine mutation. In some cases, the mutation at amino acid position 24 comprises an arginine to glycine mutation.

In some embodiments, the plant or seed is generated from i) a cross between a plant having the *dura* shell phenotype and a plant having the *pisifera* shell phenotype, ii) the selfing of a *tenera* palm, iii) a cross between two plants having the *tenera* shell phenotype, iv) a cross between a plant having the *dura* shell phenotype and a plant having the *tenera* shell phenotype, or v) a cross between a plant having the *tenera* shell phenotype and a plant having the *pisifera* shell phenotype. In some embodiments, the plant is less than 5 years old. In some embodiments, the plant is less than one year old. In some embodiments, the polymorphic marker is, or is at least, 86, 88, 90, 92, 94, 96, 97, 98, or 99% predictive of the *tenera* phenotype.

In some embodiments, the method further comprises selecting the seed or plant for cultivation if the plant is heterozygous for the polymorphic marker (e.g., heterozygous for a *dura* and a *pisifera* marker predicting a *tenera* phenotype). In some embodiments, the method further comprises selecting the seed or plant for cultivation if the plant is homozygous for a polymorphic marker (e.g., indicating a *dura* or a *pisifera* phenotype). In some embodiments, plants or seeds are discarded, stored (e.g., stored separately from *tenera* plants or seeds) or cultivated (e.g., cultivated separately from *tenera* plants or seeds) if the plants or seeds do not have a genotype predictive of the *tenera* shell phenotype, such as if the plants or seeds have a genotype predictive of a *pisifera* phenotype or have a genotype predictive of a *dura* phenotype.

Also provided is a method for segregating a plurality of palm (e.g., oil palm) plants into different categories based on predicted shell phenotype. In some embodiments, the method comprises, providing a sample from each plant in the plurality of plants; determining from the samples the genotype of at least one polymorphic marker at a position in exon 1 of the SHELL gene selected from the group consisting of: (i) nucleotides 7, 8, 9, 13, 14, 15, 22, 23, 24, 25, 26, 27, 28, 29, 30, 31, 32, 33, 34, 35, 36, 37, 61, 62, 63, 64, 65, 66, 67, 68, 69, 70, 71, 72, 73, 74, 75, 76, 77, 78, 79, 80, 81, 82, 83, 84, 85, 87, 88, 89, 90, 91, 92, 109, 110, 111, 114, 121, 122, and 123; (ii) nucleotides 23, 24, 25, 26, 27, 28, 29, 30, 31, 32, 33, 34, 35, 36, and 37; (iii) nucleotide 34; (iv) nucleotides 67, 68, 69, 70, 71, 72, 73, 74, 75, 76, 77, 78, 79, 80, 81, 82, 83, 84, 85, 87, 88, 89, 90, 91, and 92; (v) nucleotides 67, 69, 70, and 71; (vi) nucleotide 67; (vii) nucleotide 69; (viii) nucleotide 70; (ix) nucleotide 71; (x) nucleotide 110; (xi) nucleotide 114; or (xii) nucleotide 122; and segregating the plants into groups based on the genotype of the polymorphic marker, wherein the groups correspond to plants predicted to have the *tenera* shell phenotype, plants predicted to have the *dura* shell phenotype, and plants predicted to have the *pisifera* shell phenotype.

Also provided are kits for determining the shell phenotype of a palm seed or plant. In some embodiments, the kit comprises, one or more oligonucleotide primers or probes that independently comprise:

a sequence of at least, e.g., 6, 7, 8, 9, 10, 11, 12, 13, 14, 15, 16, 17, or 18 (or 20, 22, 24, 30, or more) consecutive nucleotides of SEQ ID NO:27; or;

a sequence 100% complementary to at least e.g., 6, 7, 8, 9, 10, 11, 12, 13, 14, 15, 16, 17, or 18 (or 20, 22, 24, 30, or more) consecutive nucleotides of SEQ ID NO:27, wherein the one or more primers or probes independently hybridize to a sequence that is within, or within about, 5,000; 2,500; 1,000; 750; 500; 250; 200; 150; 100; 75; 50; 25, or 1 bp of a position in exon 1 of the SHELL gene selected from the group consisting of:

(i) nucleotides 7, 8, 9, 13, 14, 15, 22, 23, 24, 25, 26, 27, 28, 29, 30, 31, 32, 33, 34, 35, 36, 37, 61, 62, 63, 64, 65, 66, 67, 68, 69, 70, 71, 72, 73, 74, 75, 76, 77, 78, 79, 80, 81, 82, 83, 84, 85, 87, 88, 89, 90, 91, 92, 109, 110, 111, 114, 121, 122, and 123;

(ii) nucleotides 23, 24, 25, 26, 27, 28, 29, 30, 31, 32, 33, 34, 35, 36, and 37;

(iii) nucleotide 34;

(iv) nucleotides 67, 68, 69, 70, 71, 72, 73, 74, 75, 76, 77, 78, 79, 80, 81, 82, 83, 84, 85, 87, 88, 89, 90, 91, and 92

(v) nucleotides 67, 69, 70, and 71;

(vi) nucleotide 67;

(vii) nucleotide 69;

(viii) nucleotide 70;

(ix) nucleotide 71;

(x) nucleotide 110;

(xi) nucleotide 114; or (xii) nucleotide 122.

In some embodiments, the one or more primers or probes independently hybridize to a sequence that is adjacent to, or contains, a position in exon 1 of the SHELL gene selected from the group consisting of one or more of the foregoing groups of nucleotides (i)-(xii).

In some embodiments, the one or more primers or probes specifically hybridize to palm plant DNA or RNA.

In some embodiments, a detectable label is linked (e.g., covalently linked) to the oligonucleotide. In some embodiments, the detectable label is fluorescent.

In some embodiments, the kit further comprises a polynucleotide encoding a polypeptide comprising a sequence substantially (e.g., a least 80, 85, 90, 95, 97, 98, 99%) identical or identical to at least 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides of SEQ ID NO: 13, 14, 15, 16, 17, 18, 19, 20, or 21, wherein the polynucleotide comprises a mutation depicted in SEQ ID NO:13, 14, 15, 16, 17, 18, 19, 20, or 21 relative to wild-type, $sh^{AVROS}$, or $sh^{MPOB}$ SHELL.

Also provided is an isolated nucleic acid comprising a polynucleotide encoding a polypeptide comprising a sequence substantially (e.g., a least 80, 85, 90, 95, 97, 98, 99%) identical or identical to at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive amino acids of SEQ ID NO:3, 4, 5, 6, 7, 8, 9, 10, or 11, wherein the polynucleotide comprises a mutation depicted in SEQ ID NO:13, 14, 15, 16, 17, 18, 19, 20, or 21 relative to wild-type, $sh^{AVROS}$, or $sh^{MPOB}$ SHELL.

Also provided is a cell or seed or plant comprising a heterologous expression cassette, the expression cassette comprising a heterologous promoter operably linked to a polynucleotide encoding a polypeptide comprising a sequence substantially (e.g., a least 80, 85, 90, 95, 97, 98, 99%) identical or identical to SEQ ID NO:3, 4, 5, 6, 7, 8, 9, 10, or 11, e.g., wherein the polynucleotide comprises a mutation depicted in SEQ ID NO: 13, 14, 15, 16, 17, 18, 19, 20, or 21 relative to wild-type, $sh^{AVROS}$, or $sh^{MPOB}$ SHELL. In some embodiments, the seed or plant is a palm (e.g., oil palm) seed or palm (e.g., oil palm) plant. In some embodiments, the polypeptide comprises the amino acid sequence of SEQ ID NO:3, 4, 5, 6, 7, 8, 9, 10, or 11. In some embodiments, the heterologous promoter results in expression level of an RNA encoding the polypeptide in the seed or plant that is less than, equal to, or more than expression of an endogenous SHELL RNA in the seed or plant. In some embodiments, the seed or plant comprises two dura alleles of an endogenous SHELL gene. In some embodiments, the seed or plant produces fruit having mature shells that are on average less than 2 mm thick, less than 3 mm thick, or are between 0.5 and 3 mm thick.

Also provided is a cell or seed or plant comprising a heterologous expression cassette, the expression cassette comprising a promoter operably linked to a polynucleotide having at least 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides of SEQ ID NO:13, 14, 15, 16, 17, 18, 19, 20, or 21, or a complement thereof, which polynucleotide, when expressed in the seed or plant, reduces expression of an endogenous SHELL polypeptide in the seed or plant (compared to a control plant lacking the expression cassette), wherein reduced expression of the SHELL polypeptide results in reduced shell thickness of the future seeds produced by the plant. In some embodiments, the polynucleotide encodes an siRNA, antisense polynucleotide, a microRNA, or a sense suppression nucleic acid, thereby suppressing expression of an endogenous SHELL gene. In some embodiments, the seed or plant makes mature shells that are on average less than 2 mm thick, less than about 3 mm thick, or are between 0.5 and 3 mm thick.

Also provided is a method of making a plant as described above or elsewhere herein, comprising introducing the expression cassette into a plant.

Also provided is a method of cultivating the plants described herein.

Other embodiments will be evident from reading the rest of the disclosure.

Definitions

A "shell phenotype" refers to the three fruit forms of E. guineensis-dura, tenera and pisifera. The dura (wild-type) fruit form is exemplified by the presence of a shell having an average thickness of at least 2-8 mm and is typically found in palm plants having a homozygous wild-type SHELL genotype. The pisifera fruit form is exemplified by the absence of a shell and is typically found in palm plants that lack a functional SHELL gene. For example, a pisifera palm plant can have two non-functional SHELL genes (e.g., homozygous for a non-functional SHELL genotype or heterozygous for two different non-functional SHELL genotypes). The tenera fruit form is exemplified by the presence of a thin shell having an average thickness of less than about 3 mm (e.g., approximately 0.5-3 mm) and is typically found in palm plants that are heterozygous for a functional and a non-functional SHELL gene. Heterologous palm plants that overexpress or underexpress the SHELL gene or gene product or partially or completely interfere with the activity of an endogenous SHELL gene product can also exhibit a dura, tenera, or pisifera fruit form phenotype.

A "polymorphic marker" refers to a genetic marker that distinguishes between two alleles. The polymorphic marker can be a nucleotide substitution, insertion, deletion, or rearrangement, or a combination thereof.

As used herein, "detecting a genotype" refers to: (i) analyzing a nucleic acid to determine a genotype by performing a sequencing, hybridization, polymerization, or sequence specific endonuclease digestion reaction or by detecting the mass of the nucleic acid, or a portion thereof; or (ii) analyzing a polypeptide, or portion thereof, encoded by the nucleic acid by performing a sequencing, detection (e.g., ELISA), or sequence specific proteolytic digestion reaction, or by detecting the mass of the polypeptide, or a portion thereof.

As used herein, the terms "nucleic acid," "polynucleotide" and "oligonucleotide" refer to nucleic acid regions, nucleic acid segments, primers, probes, amplicons and oligomer fragments. The terms are not limited by length and are generic to linear polymers of polydeoxyribonucleotides (containing 2-deoxy-D-ribose), polyribonucleotides (containing D-ribose), and any other N-glycoside of a purine or pyrimidine base, or modified purine or pyrimidine bases. These terms include double- and single-stranded DNA, as well as double- and single-stranded RNA.

A nucleic acid, polynucleotide or oligonucleotide can comprise, for example, phosphodiester linkages or modified linkages including, but not limited to phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages.

A nucleic acid, polynucleotide or oligonucleotide can comprise the five biologically occurring bases (adenine, guanine, thymine, cytosine and uracil) and/or bases other than the five biologically occurring bases.

Optimal alignment of sequences for comparison may be conducted by the local homology algorithm of Smith and Waterman Add. APL. Math. 2:482 (1981), by the homology alignment algorithm of Needle man and Wunsch J. Mol.

Biol. 48:443 (1970), by the search for similarity method of Pearson and Lipman *Proc. Natl. Acad. Sci. (U.S.A.)* 85: 2444 (1988), by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

"Percentage of sequence identity" is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

The term "substantial identity" of polypeptide sequences means that a polypeptide comprises a sequence that has at least 75% sequence identity. Alternatively, percent identity can be any integer from 75% to 100%. Exemplary embodiments include at least: 75%, 80%, 85%, 90%, 95%, or 99% compared to a reference sequence using the programs described herein; preferably BLAST using standard or default parameters, as described below. One of skill will recognize that these values can be appropriately adjusted to determine corresponding identity of proteins encoded by two nucleotide sequences by taking into account codon degeneracy, amino acid similarity, reading frame positioning and the like. Polypeptides which are "substantially similar" share sequences as noted above except that residue positions which are not identical may differ by conservative amino acid changes. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; a group of amino acids having acidic side chains is aspartic acid and glutamic acid; and a group of amino acids having sulfur-containing side chains is cysteine and methionine. Preferred conservative amino acids substitution groups are: valine-leucine-isoleucine, phenylalanine-tyrosine, lysine-arginine, alanine-valine, aspartic acid-glutamic acid, and asparagine-glutamine.

One indication that nucleotide sequences are substantially identical is if two molecules hybridize to each other, or a third nucleic acid, under stringent conditions. Stringent conditions are sequence dependent and will be different in different circumstances. Generally, stringent conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. Typically, stringent conditions will be those in which the salt concentration is about 0.02 molar at pH 7 and the temperature is at least about 60° C.

The term "promoter" or "regulatory element" refers to a region or sequence determinants located upstream or downstream from the start of transcription and which are involved in recognition and binding of RNA polymerase and other proteins to initiate transcription. Promoters need not be of plant origin, for example, promoters derived from plant viruses, such as the CaMV35S promoter, can be used.

The term "plant" includes whole plants, shoots, vegetative organs/structures (e.g. leaves, stems and tubers), roots, flowers and floral organs/structures (e.g. bracts, sepals, petals, stamens, carpels, anthers and ovules), seed (including embryo, endosperm, and seed coat) and fruit (the mature ovary), plant tissue (e.g. vascular tissue, seed tissue, ground tissue, and the like) and cells (e.g. guard cells, egg cells, trichomes and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, and multicellular algae. It includes plants of a variety of ploidy levels, including aneuploid, polyploid, diploid, haploid and hemizygous. In an exemplary embodiment, the plant is an oil palm plant (*E. guineensis* or *E. oleifera*, or a hybrid thereof). In some cases, the plant is *E. guineensis*.

An "expression cassette" refers to a nucleic acid construct, which when introduced into a host cell, results in transcription and/or translation of a RNA or polypeptide, respectively. Antisense constructs or sense constructs that are not or cannot be translated are expressly included by this definition. The expression cassette can contain a heterologous promoter.

The term "operably linked" refers to a functional linkage between a nucleic acid expression control sequence (such as a promoter, or array of transcription factor binding sites) and a second nucleic acid sequence, wherein the expression control sequence directs transcription of the nucleic acid corresponding to the second sequence.

A polynucleotide sequence or amino acid sequence is "heterologous to" an organism or a second polynucleotide sequence if it originates from a foreign species, or, if from the same species, is modified from its original form. For example, a heterologous promoter operably linked to a coding sequence refers to a promoter from a species different from that from which the coding sequence was derived, or, if from the same species, a promoter that is different from any naturally occurring allelic variants, or a promoter that is not naturally found to be operably linked to the specified coding sequence in the specified plant.

As used herein, the term "nucleotide position" and the like, in the context of a nucleotide position of exon 1 of the SHELL gene refers to the position of a nucleotide relative to the adenosine of the wild-type SHELL gene initiator (i.e., amino terminal) methionine triplet codon ("ATG"). Thus, e.g., nucleotide position 1 refers to the adenosine of the ATG initator methionine triplet codon of the wild-type SHELL gene; and, position 2 refers to the next nucleotide (i.e., "T" of the ATG initiator methionine triplet codon), and so on. Similarly, in the context of a nucleotide position of intron 1 of the SHELL gene, the term "nucleotide position" and the like refers to the position of a nucleotide relative to the first nucleotide of intron 1 of the wild-type SHELL gene. Thus, the first nucleotide of intron 1 of the SHELL gene is at position 1, the second at position 2, and so on.

Similarly, the term "amino acid position" in the context of a particular amino acid, or group of amino acids, of the SHELL gene refers to an amino acid position relative to the initiator (i.e., amino terminal) methionine of the SHELL gene. Thus, for example, amino acid position 1 refers to the amino terminal methionine, amino acid position 2 refers to the adjacent glycine of the wild-type SHELL or an alternative amino acid or deletion found in a mutatnt SHELL allele at the same position. It will be appreciated that these positions are independent of any N-terminal degradation or conjugation or other post-translational processing. For example, in a SHELL polypeptide in which the N-terminal methionine amino acid is removed post-translationally, position 2 still refers to the previously adjacent glycine amino acid and position 3 refers to the adjacent arginine amino acid of the wild-type SHELL or an alternative amino acid or deletion found in a mutant SHELL allele at the same position.

DETAILED DESCRIPTION OF THE INVENTION

I. Introduction

Figure 1:
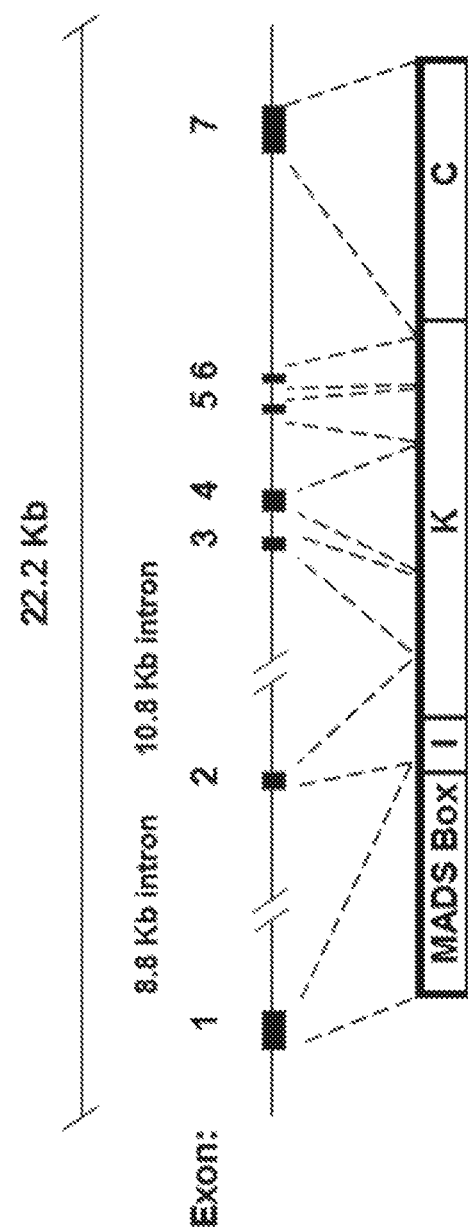
FIG. 1. SHELL gene model. Exons (boxes) and introns (horizontal lines) were validated by RNA-seq. A diagram of protein domains encoded by the indicated exons is provided below the gene diagram. MADS box, I, K and C domains of the SHELL protein are indicated.

The present disclosure describes the discovery of alleles 3-10 of the SHELL gene that are predicted to modulate the fruit form phenotype of palm (e.g., oil palm) plants. Similarly, alleles 11 (depicted in SEQ ID NOs: 11 and 21) and 12 (depicted in SEQ ID NO: 12) are either predicted to modulate the fruit form phenotype directly or can be used to infer the genotype of the SHELL gene due to their close physical linkage to the allele 3-10 polymorphisms. A polymorphic marker closely linked to the SHELL gene, or the identification of the presence, absence, or number of copies of alleles 3-11 in an oil palm plant can be used by seed producers as a quality control tool to i) reduce or eliminate *dura* or *pisifera* contamination of *tenera* seed or plantlets, ii) reduce or eliminate *dura* or *tenera* contamination of *pisifera* seed or plantlets, iii) reduce or eliminate *pisifera* or *tenera* contamination of *dura* seed or plantlets, iv) positively identify *tenera* seeds or plantlets which are then selected as suitable planting material for commercial palm oil production, v) positively identify *dura* seeds or plantlets which can then be selected as suitable planting material for commercial production of *dura* germplasm, or vi) positively identify *pisifera* seeds or plantlets which can then be selected as suitable planting material for commercial production of *pisifera* germplasm.

The identification of the SHELL gene or a marker genetically linked to shell trait is also of importance in breeding programmes. The marker or the alleles of the gene responsible for the trait can be used to separate the *dura, tenera* and *pisifera* plants in the nursery; the advantage here being that they could be planted separately based on shell fruit form phenotype. This is of interest as the *pisifera* palms usually show very vigorous vegetative growth, so in a trial consisting of all three types, distortion of results could occur due to intra-cross competition. Furthermore, separating out the *pisifera* palms and planting them in high density encourages male inflorescence and this facilitates pollen production which is used in breeding programmes (Jack et al., 1998). Accordingly, following detection of the presence or absence of a SHELL genotype predicted to result in a *dura, pisifera*, or *tenera* phenotype, or a linked marker as described below, a further step of: (1) reduction elimination of *dura* or *pisifera* contamination of *tenera* seed or plantlets, (2) positive identification of *tenera* seeds or plantlets which are then selected as suitable planting material for commercial palm oil production, or (3) separating *dura, tenera* and *pisifera* plants into two or more groups (e.g., plants predicted to be *tenera* in one group and plants predicted to be *dura* or *pisifera* in a second group; plants predicted to be *dura* in one group and plants predicted to be *tenera* or *pisifera* in a second group; plants predicted to be *pisifera* in one group and plants predicted to be *dura* or *tenera* in a second group, or separating into three groups: *dura, pisifera*, and *tenera*) can be achieved.

Any marker that exists that is polymorphic between the parent *dura* and *pisifera* trees in a cross and is linked to the shell locus has the potential to serve as a molecular signal to identify *tenera* trees in a cross. For example, if a *dura* tree, which is homozygous for "T" (i.e., T/T) at a given SNP position near the shell locus is crossed with a *pisifera* tree that is homozygous for "A" (i.e., A/A) at the same SNP position, then one could genotype seeds of the cross, or one could genotype plantlets arising from seeds of the cross, at the SNP position to track and identify contaminant seeds or plantlets. Seeds that are determined to be heterozygous at the SNP position, (i.e., A/T) are very likely to be *tenera*, unless a recombination between the marker and the shell gene had occurred in the individual being genotyped. Similarly, seeds which are homozygous at the SNP position for "A" or "T", (i.e., A/A or T/T), are *pisifera* or *dura* contaminant trees respectively, and when these trees become sexually mature in several years, they will produce suboptimal fruit types. Additionally, seeds or plantlets which have a "C" or "G" in the SNP position, neither of which is present in paternal palm of the cross, are likely trees arising from a different pollen donor than the one intended in the cross, and therefore can be discarded as contaminant seeds or plantlets. Markers that are in closer proximity to the SHELL locus would have higher predictive accuracy than markers that are farther away from the shell locus, because the closer the marker is to the shell gene, the less likely a recombination could occur which would break the linkage between the marker and the shell gene. Consequently, polymorphic markers within the shell gene itself are expected to have the strongest predictive power, and analysis of multiple markers closely linked to or within the shell gene may be advantageous.

II. Determination of Shell Phenotype Based on Nucleic Acid Detection

In view of the discovery that the SHELL genotype segregates with the *tenera/pisifera/dura* shell phenotype, genotyping a plant or seed at the SHELL locus or at adjacent genomic regions can be used to predict the shell phenotype of a palm plant.

SEQ ID NO:24 represents the predicted amino acid sequence of the N-terminal 181 amino acids of the protein expressed in oil palm of the *dura* fruit type ($Sh^{DeliDura}$). The endogenous protein includes additional C-terminal amino acids not included in SEQ ID NO:24. In oil palm of the *dura* fruit type, the proteins derived from both alleles of the gene include: (i) an isoleucine (I), lysine (K), arginine (R), isoleucine (I), and glutamate (E) at positions 8-12 respectively, which are deleted in predicted *pisifera* allele 7; (ii) a glutamate (E) at position 12, which is mutated to a glutamine (Q) in predicted *pisifera* allele 6; (iii) a lysine (K) at position 23 which is mutated to a glutamine (Q) in predicted *pisifera* allele 3 and an asparagine (N) in predicted *pisifera* allele 5; (iv) an arginine (R), which is mutated to a histidine (H) in predicted *pisifera* allele 8 and a glycine (G) in predicted *pisifera* allele 9; (v) a leucine (L) at position 29, which is mutated to a proline in the *pisifera* allele $sh^{MPOB}$; (vi) a lysine (K) at position 31, which is mutated to an asparagine in the *pisifera* allele $sh^{AVROS}$; (vii) a valine (V) at position 37, which is mutated to an aspartate (D) in predicted *pisifera* allele 10; and (viii) an alanine (A) at position 41, which is mutated to an aspartate (D) in predicted *pisifera* allele 4.

SEQ ID NO:1 represents the predicted amino acid sequence of the N-terminal 181 amino acids of the protein expressed in oil palm of the *pisifera* fruit type that is derived from the Zaire line ($sh^{AVROS}$). The endogenous protein includes additional C-terminal amino acids not included in SEQ ID NO: 1. This polypeptide includes an asparagine (N) amino acid at the $31^{st}$ amino acid position. A nucleotide sequence encoding exon 1 of the $sh^{AVROS}$ allele is provided in SEQ ID NO:22.

SEQ ID NO:2 represents the predicted amino acid sequence of the N-terminal 181 amino acids of the protein expressed in oil palm of the *pisifera* fruit type that is derived from the Nigerian line ($sh^{MPOB}$). The endogenous protein includes additional C-terminal amino acids not included here. This polypeptide includes a proline (P) amino acid at the $29^{th}$ amino acid position. A nucleotide sequence encoding exon 1 of the $sh^{MPOB}$ allele is provided in SEQ ID NO:23.

SEQ ID NO:3 represents the predicted amino acid sequence of the N-terminal 181 amino acids of the protein expressed in oil palm of the predicted *pisifera* fruit type SHELL allele 3. The endogenous protein includes additional C-terminal amino acids not included here. This polypeptide includes a glutamine (Q) amino acid at the $23^{rd}$ amino acid position. A nucleotide sequence encoding exon 1 of allele 3 is provided in SEQ ID NO: 13.

SEQ ID NO:4 represents the predicted amino acid sequence of the N-terminal 181 amino acids of the protein expressed in oil palm of the predicted *pisifera* fruit type SHELL allele 4. The endogenous protein includes additional C-terminal amino acids not included here. This polypeptide includes an aspartate (D) amino acid at the $41^{st}$ amino acid position. A nucleotide sequence encoding exon 1 of allele 4 is provided in SEQ ID NO: 14.

SEQ ID NO:5 represents the predicted amino acid sequence of the N-terminal 181 amino acids of the protein expressed in oil palm of the predicted *pisifera* fruit type SHELL allele 5. The endogenous protein includes additional C-terminal amino acids not included here. This polypeptide includes an asparagine (N) amino acid at the $23^{rd}$ amino acid position. A nucleotide sequence encoding exon 1 of allele 5 is provided in SEQ ID NO: 15.

SEQ ID NO:6 represents the predicted amino acid sequence of the N-terminal 181 amino acids of the protein expressed in oil palm of the predicted *pisifera* fruit type SHELL allele 6. The endogenous protein includes additional C-terminal amino acids not included here. This polypeptide includes a glutamine (E) amino acid at the $12^{th}$ amino acid position. A nucleotide sequence encoding exon 1 of allele 6 is provided in SEQ ID NO:16.

SEQ ID NO:7 represents the predicted amino acid sequence of the N-terminal 181 amino acids of the protein expressed in oil palm of the predicted *pisifera* fruit type SHELL allele 7. The endogenous protein includes additional C-terminal amino acids not included here. This polypeptide has a deletion of amino acids lysine (K), arginine (R), isoleucine (I), and glutamate (E), at positions 8-12 respectively in comparison to wildtype allele $Sh^{DeliDura}$. A nucleotide sequence encoding exon 1 of allele 7 is provided in SEQ ID NO: 17.

SEQ ID NO:8 represents the predicted amino acid sequence of the N-terminal 181 amino acids of the protein expressed in oil palm of the predicted *pisifera* fruit type SHELL allele 8. The endogenous protein includes additional C-terminal amino acids not included here. This polypeptide includes a histidine (H) amino acid at the $24^{th}$ amino acid position. A nucleotide sequence encoding exon 1 of allele 8 is provided in SEQ ID NO: 18.

SEQ ID NO:9 represents the predicted amino acid sequence of the N-terminal 181 amino acids of the protein expressed in oil palm of the predicted *pisifera* fruit type SHELL allele 9. The endogenous protein includes additional C-terminal amino acids not included here. This polypeptide includes a glycine (G) amino acid at the $24^{th}$ amino acid position. A nucleotide sequence encoding exon 1 of allele 9 is provided in SEQ ID NO: 19.

SEQ ID NO: 10 represents the predicted amino acid sequence of the N-terminal 181 amino acids of the protein expressed in oil palm of the predicted *pisifera* fruit type SHELL allele 10. The endogenous protein includes additional C-terminal amino acids not included here. This polypeptide includes an aspartate (D) amino acid at the $37^{th}$ amino acid position. A nucleotide sequence encoding exon 1 of allele 10 is provided in SEQ ID NO:20.

SEQ ID NO: 11 represents the predicted amino acid sequence of the N-terminal 181 amino acids of the protein expressed in oil palm of the predicted *pisifera* fruit type SHELL allele 11. The endogenous protein includes additional C-terminal amino acids not included here. The allele encodes a silent mutation with respect to a wild-type SHELL gene ($Sh^{DeliDura}$). A nucleotide sequence encoding exon 1 of allele 11 is provided in SEQ ID NO:21. As described herein, this silent mutation may affect transcriptional or translational regulation and therefore provide a *pisifera* phenotype despite encoding for a wild-type protein sequence. Alternatively, the nucleotide sequence encoding for this silent mutation can be used to infer the presence or absence of a genotype at one or more of the foregoing polymorphic nucleotide (e.g., one or more of the polymorphic markers relative to wild-type exemplified in SEQ ID Nos: 13-20, 13-20 and 23, 13-20 and 22, or 13-20 and 22-23) or amino acid markers (e.g., one or more of the polymorphic markers relative to wild-type exemplified in SEQ ID Nos: 3-10, 2-10, 1 and 3-10, or 1-10).

SEQ ID NO:12 represents the nucleotide sequence of the first 56 nucleotides of intron 1 of SHELL allele 12 in which nucleotides 43, 44, 45, and 46 are deleted relative to intron 1 of a wild-type SHELL allele ($Sh^{DeliDura}$). As this polymorphism is within a non-coding region of the SHELL gene, it is a silent mutation. As described herein, this silent mutation may affect transcriptional or translational regulation, or splicing, and therefore provide a *pisifera* phenotype. Alternatively, the presence or absence of allele 12 can be used to infer the presence or absence of a genotype at one or more of the foregoing polymorphic nucleotide (e.g., one or more of the polymorphic markers relative to wild-type exemplified in SEQ ID Nos: 13-20, 13-21, 13-20 and 22, 13-20 and 23, or 13-23) or amino acid markers (e.g., one or more of the polymorphic markers relative to wild-type exemplified in SEQ ID Nos: 3-10, 3-11, 2-10, 2-11, 1-10, 1 and 3-10, 1 and 3-11, or 1-11).

Oil palm trees of the *pisifera* fruit type are the result of one of at least four possibilities: i) two homozygous SHELL alleles having a nucleotide sequence coding for one of the following protein sequences: SEQ ID NOs:3-10; ii) two heterozygous SHELL alleles having two different nucleotide sequences independently coding for one of following protein sequences: SEQ ID NOs:3-10, or iii) one SHELL allele coding for the $Sh^{AVROS}$ or $Sh^{MPOB}$ protein sequence and the other allele coding for a mutation relative to wild-type represented in one or more of the following protein sequences: SEQ ID NOs:3-10. In some cases, nucleotide sequences comprising SEQ ID NO: 12 and/or 21 are similarly, predicted *pisifera* alleles. In such cases, a *pisifera* fruit type can result in plants homozygous for SEQ ID NO: 12 or 21 or heterozygous for SEQ ID NO: 12 or 21 and a different allele selected from the group consisting of any one of SEQ ID NOs:13-23 (e.g., any one of SEQ ID NOs:13-20) or encoding any one of SEQ ID NOs:1-10 (e.g., any one of SEQ ID NOs:3-10).

Oil palm trees of the *tenera* fruit type are the result of one allele coding for one or more of the *pisifera* alleles described herein and one allele coding for a wild-type ($Sh^{DeliDura}$) SHELL protein. It will be appreciated that SEQ ID NOs: 1-11 and 24 are representative sequences and that different individual palms may have an amino acid sequence having one, two, three, four, or more amino acid changes relative to SEQ ID NOS:1-11 and 24, due, for example, to natural variation. Similarly SEQ ID NOs: 12-23 and 25 are representative sequences and different individual palms may have a nucleotide sequence having one, two, three, four, or more nucleotide changes relative to SEQ ID NOs: 12-23 and 25 due to, for example, natural variation.

One or more polymorphism(s) between *pisifera* and *dura* SHELL alleles can be used to determine the shell phenotype of a palm or other plant. For example, when the polymorphism is co-dominant (detectable independent of the other allele) then:

the presence of only a *dura* SHELL allele indicates that the plant has or will have a *dura* shell phenotype;

the presence of only a *pisifera* SHELL allele indicates that the plant has or will have a *pisifera* shell phenotype; and the presence of a *pisifera* SHELL allele and a *dura* SHELL allele indicates that the plant has or will have a *tenera* shell phenotype.

However, genomic regions adjacent to the SHELL gene are also useful to determining whether a palm plant will likely manifest a particular shell phenotype. Because of genetic linkage to the SHELL gene, polymorphisms adjacent to the SHELL locus are predictive of shell phenotype, albeit with reduced accuracy as a function of increased distance from the SHELL locus. SEQ ID NO:27 provides an approximately 3.4 MB genomic region of the palm genome that comprises the SHELL gene. Table A of U.S. Patent Application Publication No. 2013/0247249 discloses 8217 SNPs identified within SEQ ID NO:27. A selection of these SNPs have been genetically mapped relative to the SHELL locus. The estimated predictive values of these SNPs are also described in Table A of U.S. 2013/0247249. Thus, as an example, the SNP listed in row 1 of U.S. 2013/0247249, Table A as having a estimated prediction success of 83, represents an SNP that is accurate in predicting shell phenotype 83% of the time. Said another way, by using this SNP as a genetic marker, one can correctly predict shell phenotype of palm plants 83 out of 100 times. Thus, even at a significant physical distance from the SHELL locus on the palm chromosome, polymorphic markers allow for relatively accurate prediction of shell phenotype of plants. In some embodiments, the polymorphic marker is within 1, 10, 20, 50, 100, 200, 500, 1000 kb from the SHELL gene (e.g., the gene corresponding to SEQ ID NO:28).

Accordingly, methods of detecting one or more polymorphic marker within a region of the palm genome corresponding to SEQ ID NO:27 are provided. Such methods are useful for predicting shell phenotype of palm plants for example. While over 8200 specific polymorphisms are provided in U.S. 2013/0247249, it should be appreciated that the polymorphisms represented are merely an example of polymorphisms within the genomic region corresponding to SEQ ID NO:27. Additional polymorphisms can be identified as desired and also be used to predict shell phenotype of a palm plant. Such additional polymorphisms are intended to be encompassed in the methods described herein. Moreover, it will be appreciated that SEQ ID NO:27 is a representative sequence and that different individual palms may have a corresponding genomic region having one or more nucleotide changes relative to SEQ ID NO:27 due, for example, to natural variation. As noted elsewhere herein, nevertheless, identifying the region of a genome corresponding to SEQ ID NO:27 can be readily determined using alignment programs, etc.

The nucleic acid sequences provided herein were generated by nucleotide sequencing and on occasion, include one or more stretches of "N's." These stretches of N's represent gaps in assembly of sequences of an estimated size. The precise number of N's in a sequence is an estimate (for example, 100 N's may only represent 30 bases). N's can be any base, and are likely repetitive sequence in the genome.

Detecting specific polymorphic markers can be accomplished by methods known in the art for detecting sequences at polymorphic sites. For example, standard techniques for genotyping for the presence of SNPs and/or microsatellite markers can be used, such as fluorescence-based techniques (Chen, X. et al., Genome Res. 9(5): 492-98 (1999)), utilizing PCR, LCR, Nested PCR and other techniques for nucleic acid amplification. Specific commercial methodologies available for SNP genotyping include, but are not limited to, TaqMan™ genotyping assays and SNPlex platforms (Applied Biosystems), gel electrophoresis (Applied Biosystems), mass spectrometry (e.g., MassARRAY system from Sequenom), minisequencing methods, real-time PCR, BioPlex system (BioRad), CEQ and SNPstream systems (Beckman), array hybridization technology (e.g., Affymetrix GeneChip; Perlegen), BeadArray Technologies (e.g., Illumina GoldenGate and Infinium assays), array tag technology (e.g., Parallele), and endonuclease-based fluorescence hybridization technology (Invader; Third Wave). Some of the available array platforms, including Affymetrix SNP Array 6.0 and Illumina CNV370-Duo and 1M BeadChips, include SNPs that tag certain copy number variants.

In certain embodiments, polymorphic markers are detected by sequencing technologies. Obtaining sequence information about an individual plant identifies particular nucleotides in the context of a sequence. For SNPs, sequence information about a single unique sequence site is sufficient to identify alleles at that particular SNP. For markers comprising more than one nucleotide, sequence information about the nucleotides of the individual that contain the polymorphic site identifies the alleles of the individual for the particular site.

Various methods for obtaining nucleic acid sequence are known to the skilled person, and all such methods are useful for practicing the invention. Sanger sequencing is a well-known method for generating nucleic acid sequence information. Recent methods for obtaining large amounts of sequence data have been developed, and such methods are also contemplated to be useful for obtaining sequence information of a plant, if desired. These include, but are not limited to, pyrosequencing technology (Ronaghi, M. et al. *Anal Biochem* 267:65-71 (1999); Ronaghi, et al., *Biotechniques* 25:876-878 (1998)), e.g., 454 pyrosequencing (Nyren, P., et al. *Anal Biochem* 208:171-175 (1993)), Illumina/Solexa sequencing technology (www.illumina.com; see also Strausberg, R L, et al *Drug Disc Today* 13:569-577 (2008)), Supported Oligonucleotide Ligation and Detection Platform (SOLiD) technology (Applied Biosystems, www.appliedbiosystems.com); Strausberg, R L, et al., *Drug Disc Today* 13:569-577 (2008), single-molecule, real-time sequencing (Pacific Biosciences), and IonTorrent technology (ThermoFisher).

Methods of polymorphism detection can be performed on any type of biological sample from the plant that contains nucleic acids (e.g., DNA, RNA). As one particular advantage of the methods is to predict the shell phenotype of young plants before cultivation in the field, in some embodiments, the samples are obtained from a plant that has been germinated less than 1, 2, 4, 6, months or less than 1, 2, 3, 4, or 5 years. In some embodiments, the plants are generated from i) a cross between *dura* and *pisifera* palms ii) the selfing of a *tenera* palm, iii) a cross between two plants having the *tenera* shell phenotype, iv) a cross between *dura* and *tenera* palms, and v) a cross between *tenera* and *pisifera* palms. Because such crosses are not 100% efficient, such crosses result in some percentage of seeds or plants that will not in the future produce seeds or plants with the *tenera* shell phenotype, (in case of i) and the observed number of *tenera* palms observed do not follow the expected Mendellian segregation (ii, iii & iv). By testing seeds or plants resulting from the attempted crosses, one can reduce or eliminate non-*tenera* contaminant seeds or plants from material planted for cultivation (optionally discarding those plants that are predicted to be *dura* and/or *pisifera*). Alternatively, one can identify and segregate plants based on their predicted shell genotype, allowing for selection and cultivation of fields of pure *pisifera* and *dura* trees, if desired, e.g., for later breeding purposes.

II. Transgenic Plants

As discussed above, the SHELL gene of palm has been discovered to control shell phenotype. Thus in some embodiments, plants having modulated expression of a SHELL polypeptide are provided. The more desirable shell phenotype (*tenera*, having a shell less than 2 mm thick) occurs naturally as a heterozygote of the between the *dura* and *pisifera* allele.

It has been discovered that *pisifera* SHELL alleles contain missense mutations in portions of the gene encoding the MADS box domain of the protein, which plays a role in transcription regulation. Thus, it is hypothesized that the *tenera* phenotype can result from a mechanism involving the protein:protein interaction of non-DNA binding *pisifera* types of SHELL proteins with fully functional types of SHELL (homodimers) or other MADS-box family members (heterodimers). Thus, in some embodiments, plants that heterologously express a SHELL polypeptide with a functional M, I, and K domain and a non-functional C-(MADs-box) domain are provided. M, I, K, and C domains are described in, e.g., Gramzow and Theissen, 2010 *Genome Biology* 11: 214-224 and the corresponding domains can be identified in the palm sequences described herein. By expressing such a protein having active protein:protein interaction domains but a non-functional DNA binding domain, proteins that interact with the modified SHELL protein will be removed from biological action, thereby resulting in a reduced shell thickness. Thus, for example, one can express any of the *pisifera* alleles described herein under control of a heterologous promoter in the plant (e.g., a palm plant, e.g., a *dura* background), thereby resulting in the reduced shell thickness.

Similarly, it has been discovered that many *pisifera* SHELL alleles contain mutations in a nuclear localization signal (NLS) within a MADS box domain of the SHELL protein. Thus, it is hypothesized that the *tenera* phenotype can result from a mechanism involving protein:protein interaction between one or more *pisifera* SHELL allele proteins lacking a functional NLS and one or more fully functional types of SHELL (homodimers) or other MADS-box family members (heterodimers). By expressing such a protein having active protein:protein interaction domains but a non-functional NLS, proteins that interact with the modified SHELL protein can be inhibited (e.g., prevented) from entering the nucleus or removed from the nucleus, thereby reducing the amount of biologically active SHELL protein and its interacting protein (e.g., binding partner) in the nucleus and resulting in a reduced shell thickness. Thus, for example, one can express any of the *pisifera* alleles containing an NLS mutation described herein, or a SHELL gene encoding a SHELL protein mutated at any of the (e.g., conserved) amino acids of the NLS under the control of a heterologous promoter in the plant (e.g., a palm plant, e.g., a *dura* background), thereby resulting in the reduced shell thickness.

B. Use of Nucleic Acids of the Invention to Enhance Gene Expression

Nucleic acid sequences encoding all or an active part of a SHELL polypeptide (including but not limited to polypeptides substantially identical to any one or more of SEQ ID NOs:1-10 (e.g., any one of SEQ ID NOs:3-10), SHELL polypeptides having a functional M, I, and K domain and a non-functional C domain, or SHELL polypeptides having a non-functional NLS, which when expressed control shell thickness) can be used to prepare expression cassettes that enhance, or increase SHELL gene expression. Where overexpression of a gene is desired, the desired SHELL gene from a different species may be used to decrease potential sense suppression effects.

Any of a number of means well known in the art can be used to increase SHELL activity in plants. Any organ can be targeted, such as shoot vegetative organs/structures (e.g.

leaves, stems and tubers), roots, flowers and floral organs/ structures (e.g. bracts, sepals, petals, stamens, carpels, anthers and ovules), seed (including embryo, endosperm, and seed coat) and fruit. Alternatively, a SHELL gene can be expressed constitutively (e.g., using the CaMV 35S promoter).

One of skill will recognize that the polypeptides encoded by the genes of the invention, like other proteins, have different domains which perform different functions. Thus, the gene sequences need not be full length, so long as the desired functional domain of the protein is expressed.

III. Preparation of Recombinant Vectors

In some embodiments, to use isolated sequences in the above techniques, recombinant DNA vectors suitable for transformation of plant cells are prepared. Techniques for transforming a wide variety of higher plant species are well known and described in the technical and scientific literature. See, for example, Weising et al. *Ann. Rev. Genet.* 22:421-477 (1988). A DNA sequence coding for the desired polypeptide, for example a cDNA sequence encoding a full length protein, will preferably be combined with transcriptional and translational initiation regulatory sequences which will direct the transcription of the sequence from the gene in the intended tissues of the transformed plant.

For example, for overexpression, a plant promoter fragment may be employed which will direct expression of the gene in all tissues of a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill.

Alternatively, the plant promoter may direct expression of the polynucleotide of the invention in a specific tissue (tissue-specific promoters) or may be otherwise under more precise environmental control (inducible promoters). Examples of tissue-specific promoters under developmental control include promoters that initiate transcription only in certain tissues, such as fruit, seeds, or flowers. Examples of environmental conditions that may affect transcription by inducible promoters include anaerobic conditions, elevated temperature, or the presence of light.

If proper polypeptide expression is desired, a polyadenylation region at the 3'-end of the coding region should be included. The polyadenylation region can be derived from the natural gene, from a variety of other plant genes, or from T-DNA.

The vector comprising the sequences (e.g., promoters or coding regions) from genes of the invention can optionally comprise a marker gene that confers a selectable phenotype on plant cells. For example, the marker may encode biocide resistance, particularly antibiotic resistance, such as resistance to kanamycin, G418, bleomycin, hygromycin, or herbicide resistance, such as resistance to chlorosluforon or Basta.

SHELL nucleic acid operably linked to a promoter is provided that, in some embodiments, is capable of driving the transcription of the SHELL coding sequence in plants. The promoter can be, e.g., derived from plant or viral sources. The promoter can be, e.g., constitutively active, inducible, or tissue specific. In construction of recombinant expression cassettes, vectors, transgenics, of the invention, a different promoters can be chosen and employed to differentially direct gene expression, e.g., in some or all tissues of a plant or animal. In some embodiments, as discussed above, desired promoters are identified by analyzing the 5' sequences of a genomic clone corresponding to a SHELL gene as described here.

V. Production of Transgenic Plants

DNA constructs of the invention may be introduced into the genome of the desired plant host by a variety of conventional techniques. For example, the DNA construct may be introduced directly into the genomic DNA of the plant cell using techniques such as electroporation and microinjection of plant cell protoplasts, or the DNA constructs can be introduced directly to plant tissue using ballistic methods, such as DNA particle bombardment. Alternatively, the DNA constructs may be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria.

Various palm transformation methods have been described. See, e.g., Masani and Parveez, *Electronic Journal of Biotechnology* Vol. 11 No. 3, Jul. 15, 2008; Chowdury et al., *Plant Cell Reports*, Volume 16, Number 5, 277-281 (1997).

Microinjection techniques are known in the art and well described in the scientific and patent literature. The introduction of DNA constructs using polyethylene glycol precipitation is described in Paszkowski et al. *EMBO J* 3:2717-2722 (1984). Electroporation techniques are described in Fromm et al. *Proc. Natl. Acad. Sci. USA* 82:5824 (1985). Ballistic transformation techniques are described in Klein et al. *Nature* 327:70-73 (1987).

*Agrobacterium tumefaciens*-mediated transformation techniques, including disarming and use of binary vectors, are well described in the scientific literature. See, for example Horsch et al. *Science* 233:496-498 (1984), and Fraley et al. *Proc. Natl. Acad. Sci. USA* 80:4803 (1983).

Transformed plant cells that are derived from any transformation technique can be cultured to regenerate a whole plant that possesses the transformed genotype and thus the desired phenotype. Such regeneration techniques rely on manipulation of certain phytohormones in a tissue culture growth medium, optionally relying on a biocide and/or herbicide marker that has been introduced together with the desired nucleotide sequences. Plant regeneration from cultured protoplasts is described in Evans et al., Protoplasts Isolation and Culture, Handbook of Plant Cell Culture, pp. 124-176, MacMillilan Publishing Company, New York, 1983; and Binding, Regeneration of Plants, Plant Protoplasts, pp. 21-73, CRC Press, Boca Raton, 1985. Regeneration can also be obtained from plant callus, explants, organs, or parts thereof. Such regeneration techniques are described generally in Klee et al. *Ann. Rev. of Plant Phys.* 38:467-486 (1987).

The nucleic acids of the invention can be used to confer desired traits on essentially any plant. Thus, the invention has use over a broad range of plants, including species from the genera *Asparagus, Atropa, Avena, Brassica, Citrus, Citrullus, Capsicum, Cucumis, Cucurbita, Daucus, Fragaria, Glycine, Gossypium, Helianthus, Heterocallis, Hordeum, Hyoscyamus, Lactuca, Linum, Lolium, Lycopersicon, Malus, Manihot, Majorana, Medicago, Nicotiana, Oryza, Panieum, Pannesetum, Persea, Pisum, Pyrus, Prunus, Raphanus, Secale, Senecio, Sinapis, Solanum, Sorghum, Trigonella, Triticum, Vitis, Vigna,* and, *Zea.* Plants having a shell, and thus those that have use in the present invention, include but are not limited to dicotyledons and monocotyledons including but not limited to palm.

EXAMPLES

The following examples are offered to illustrate, but not to limit the claimed invention.

Example 1. Identification of Alleles 3-11, Corresponding to Nucleotide SEQ ID NOs:12-21 and Polypeptide SEQ ID NOs:3-11

We previously reported that the AVROS and MPOB mutations in exon 1 of the SHELL gene are responsible for the *pisifera* oil palm fruit form phenotype when homozygous (e.g., AVROS/AVROS, MPOB/MPOB or AVROS/MPOB) and the *tenera* oil palm fruit form phenotype when heterozygous along with one wildtype *dura* allele (e.g., AVROS/*dura* or MPOB/*dura*). While *tenera* oil palm is the preferred phenotype for commercial oil palm production, it is difficult to completely prevent the occurance of the wildtype *dura* palm in commercial populations. To estimate the degree of *dura* contamination within commercial oil palm populations, and to search for new alleles of the SHELL gene that are causative of the *pisifera/tenera* phenotype, we tested 5,158 oil palm trees from 6 different small holder plantations across Malaysia for the presence of the AVROS and/or MPOB alleles using an allele-specific PCR assay for each allele (*dura*, $sh^{AROS}$ and $sh^{MPOB}$). As expected, the majority of palms were heterozygous for either the $sh^{AVROS}$ or $sh^{MPOB}$ allele (Table 2).

However, 504 palms were predicted to be homozygous for the $Sh^{DeliDura}$ allele at both SNP positions. Exon 1 of the SHELL gene, encoding the entire MADS box domain, was sequenced in each of these 504 palms. Sequencing was performed on amplicons amplified by PCR using primers flanking exon 1. PCR was performed under standard conditions. Amplicons were purified and Sanger sequenced in one direction using a primer internal to the PCR amplification primers. Sequencing reads were individually analyzed within CONSED to determine the sequence and zygosity of each nucleotide position within exon 1. As shown in Table 2, 13 palms were determined to be heterozygous for the $sh^{AVROS}$ allele (2 from site 1, 4 from site 2, 2 from site 3, 3 from site 4 and 2 from site 5), indicating that these palms were indeed genotypically *tenera* palms. Three palms were determined to be heterozygous for the $sh^{MPOB}$ allele (1 from site 2, 1 from site 4 and 1 from site 5), indicating that these were also genotypically *tenera* palms. However, the remaining 488 palms were homozygous for the $Sh^{DeliDura}$ allele at both SNP positions, suggesting these trees were genotypically *dura* or that they carried previously unidentified mutant alleles of the SHELL gene.

Figure 3:
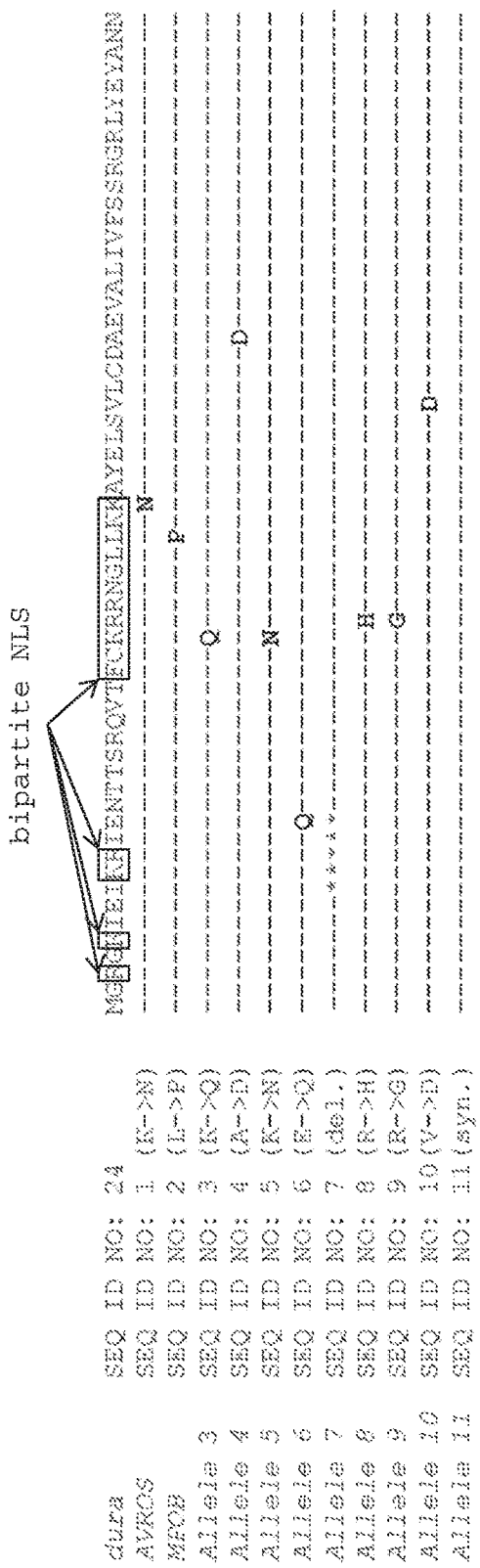
FIG. 3. Amino acid variants in the SHELL gene. The peptide sequence of the wildtype ($Sh^{DeliDura}$) MADS box domain (SEQ ID NO: 24) is shown in the top line of the peptide alignment. Sequences of the AVROS, MPOB, Allele 3, Allele 4, Allele 5, Allele 6, Allele 7, Allele 8, Allele 9, Allele 10 and Allele 11 (SEQ ID NO: 1-11, respectively) peptides are shown aligned to the *dura* peptide sequence. Variant amino acids caused by missense single nucleotide variants are indicated by the appropriate single letter amino acid code. Deleted amino acids (Allele 7) are indicated by astericks. Amino acids that are unchanged relative to *dura* peptide sequence are indicated by dashes.

Allele 3 (SEQ ID NO: 3 and 13) was found to be heterozygous in 68 palms (Table 2), Allele 4 (SEQ ID NO: 4 and 14) was found to be heterozygous in 66 palms and Allele 5 was found to be heterozygous in 1 palm. Each of these 135 palms were independent of each other. The amino acids encoded by Alleles 3 and 5 occur within the NLS of SHELL, as do the AVROS and MPOB mutations (FIG. 3). The amino acid encoded by Allele 4 lies 10 amino acids C-terminal to the amino acid mutated by the $sh^{AVROS}$ allele.

TABLE 2

Determination of SHELL exon 1 genotypes in palms sampled from small holder plantations.

| Small Holder Plantation Site | Tested[a] | Sequenced[b] | AVROS | MPOB | Allele 3 | Allele 4 | Allele 5 | Allele 6 | Allele 7 | Allele 8 | Allele 9 | Allele 10 | Allele 11 |
|---|---|---|---|---|---|---|---|---|---|---|---|---|---|
| 1 | 940 | 102 | 2 | — | 1 | 23 | 1 | — | — | — | — | — | — |
| 2 | 1,133 | 126 | 4 | 1 | — | 16 | — | — | — | — | — | — | — |
| 3 | 720 | 27 | 2 | — | — | 4 | — | — | — | — | — | — | — |
| 4 | 1,092 | 36 | 3 | 1 | — | 11 | — | — | — | — | — | — | — |
| 5 | 922 | 145 | 2 | 1 | 58 | 11 | — | — | — | — | — | — | — |
| 6 | 351 | 68 | — | — | 9 | 1 | — | — | — | — | — | — | — |

[a]Number of independent palms tested for AVROS and MPOB mutations by allele specific PCR assays
[b]Nubmer of independent palms further analyzed by DNA sequencing of exon 1 of the SHELL gene Next, we genotyped 3,952 palms from seven oil palm nursery sites throughout Malaysia (Table 3). Again, the majority were heterozygous for either the shAVROS or shMPOB allele, indicated that they were genotypically *tenera* palms. However, 536 palms were predicted to be homozygous for the $Sh^{DeliDura}$ allele at both SNP positions. Exon 1 of the SHELL gene, encoding the entire MADS box domain, was sequenced in each of these 536 palms as described above.

As shown in Table 3, 6 palms were determined to be heterozygous for the $sh^{AVROS}$ allele, indicating that these palms were indeed genotypically *tenera* palms. One palm was determined to be heterozygous for the $sh^{MPOB}$ allele. However, the remaining 529 palms were determined to be homozygous for the $Sh^{DeliDura}$ allele at both SNP positions, suggesting these trees were genotypically *dura* or that they carried previously unidentified mutant alleles of the SHELL gene. Allele 3 (SEQ ID NO: 3 and 13) was found to be heterozygous in 36 palms (Table 3), and Allele 4 (SEQ ID NO: 4 and 14) was found to be heterozygous in 2 palms. Each of these 38 palms were independent of each other.

TABLE 3

Determination of SHELL exon 1 genotypes in palms sampled from oil palm nurseries.

| Nursery Site | Tested[a] | Sequenced[b] | AVROS | MPOB | Allele 3 | Allele 4 | Allele 5 | Allele 6 | Allele 7 | Allele 8 | Allele 9 | Allele 10 | Allele 11 |
|---|---|---|---|---|---|---|---|---|---|---|---|---|---|
| 1 | 539 | 40 | 1 | — | 1 | — | — | — | — | — | — | — | — |
| 2 | 571 | 134 | — | 1 | 18 | — | — | — | — | — | — | — | — |
| 3 | 576 | 147 | 2 | — | 12 | 2 | — | — | — | — | — | — | — |

TABLE 3-continued

Determination of SHELL exon 1 genotypes in palms sampled from oil palm nurseries.

| Nursery Site | Tested[a] | Sequenced[b] | AVROS | MPOB | Allele 3 | Allele 4 | Allele 5 | Allele 6 | Allele 7 | Allele 8 | Allele 9 | Allele 10 | Allele 11 |
|---|---|---|---|---|---|---|---|---|---|---|---|---|---|
| 4 | 571 | 94 | — | — | 5 | — | — | — | — | — | — | — | — |
| 5 | 550 | 22 | 1 | — | — | — | — | — | — | — | — | — | — |
| 6 | 572 | 65 | — | — | — | — | — | — | — | — | — | — | — |
| 7 | 573 | 34 | 2 | — | — | — | — | — | — | — | — | — | — |

[a]Number of independent palms tested for AVROS and MPOB mutations by allele specific PCR assays
[b]Nubmer of independent palms further analyzed by DNA sequencing of exon 1 of the SHELL gene To further identify SHELL exon 1 variants, we sequenced exon 1 of the SHELL gene in 148 palms from germplasm collections collected from various geographical regions (64 from Angola, 28 from Ghana, 27 from Nigeria, 27 from Tanzania and 2 from Guinea). The sh$^{AVROS}$ allele was most common among populations expected to be of the *tenera* phenotype (50 Angola, 10 Ghana, 6 Nigeria, and 22 Nigeria palms), while the sh$^{MPOB}$ allele was detected in 5 Angola, 5 Ghana and 19 Nigeria palms (Table 4). Allele 4 (also detected in small holder plantations and nurseries) was detected in 1 Ghana and 2 Guinea palms.

Figure 2:
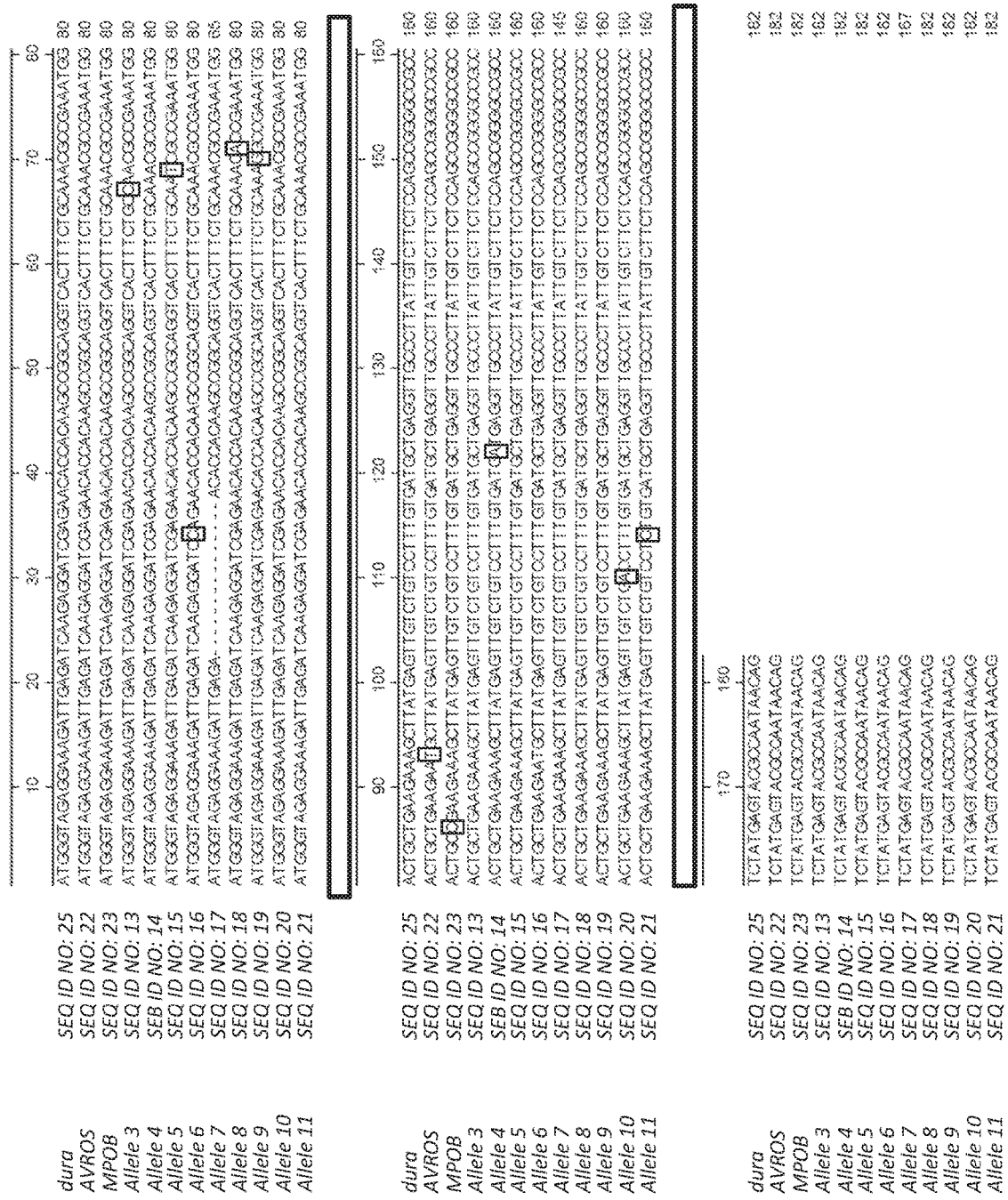
FIG. 2. Nucleotide variants in the SHELL gene. The DNA sequence of the wildtype ($Sh^{DeliDura}$) exon 1 encoding the MADS box domain of SHELL (SEQ ID NO: 25) is shown in the top line of the DNA sequence alignment. Sequences of the AVROS, MPOB, Allele 3, Allele 4, Allele 5, Allele 6, Allele 7, Allele 8, Allele 9, Allele 10 and Allele 11 (SEQ ID NO: 22, 23, 13-21, respectively) alleles are shown aligned to the *dura* sequence. Single nucleotide variants are indicated by boxes. Deleted bases (Allele 7) are indicated by dashes.

In addition, six novel SHELL alleles were detected. Allele 6 was detected in 4 Tanzania palms and encodes an aspartate to glutamine amino acid change relative to *dura* at amino acid position 12 (FIGS. 2 and 3). Allele 7, an inframe deletion removing 5 amino acids relative to *dura* was detected in 1 Nigeria palm. Alleles 8 and 9 alter the same amino acid relative to *dura*. The conserved arginine at amino acid position 24 is changed to histidine in Allele 8 and to glycine in Allele 9 (FIGS. 2 and 3). Allele 10 was detected in one Ghana palm, and it encodes a valine to glutamate amino acid substitution relative to *dura* at amino acid position 37. Finally, Allele 11 was detected in two Angola palms, and it encodes a synonomous single nucleotide polymorphism (FIG. 2). It is noteworthy that, like sh$^{AVROS}$ and sh$^{MPOB}$ mutations, Alleles 3, 5, 7, 8 and 9 all affect amino acids that are part of the highly conserved NLS of the SHELL protein.

Of 10 Ghana palms phenotyped as *tenera*, 1 was heterozygous for Allele 4 (Allele 4/Sh$^{DeliDura}$) and was wildtype (*dura*) at all other exon 1 nucleotide positions, 4 were heterozygous for Allele 8 (Allele 8/Sh$^{DeliDura}$) and were wildtype (*dura*) at all other exon 1 nucleotide positions, 4 were heterozygous for Allele 9 (Allele 9/Sh$^{DeliDura}$) and were wildtype (*dura*) at all other exon 1 nucleotide positions, and 1 was heterozygous for Allele 10 (Allele 10/Sh$^{DeliDura}$) and was wildtype (*dura*) at all other exon 1 nucleotide positions. None of the Ghana palms in this study were phenotyped as *dura*.

Of 8 Nigeria palms phenotyped as *tenera*, 3 were heterozygous for the sh$^{AVROS}$ allele (sh$^{AVROS}$/Sh$^{DeliDura}$) and wildtype (*dura*) at all other nucleotide positions, 3 were heterozygous for the sh$^{MPOB}$ allele (sh$^{MPOB}$/Sh$^{DeliDura}$) and wildtype (*dura*) at all other exon 1 nucleotide positions, and 1 was heterozygous for Allele 7 (Allele 7/Sh$^{DeliDura}$) and wildtype (*dura*) at all other exon 1 nucleotide positions. One Nigeria palm phenotyped as *tenera* was wildtype (*dura*) at all exon 1 nucleotide positions. Of two Nigeria palms phenotyped as *pisifera*, 1 was homozygous for the sh$^{AVROS}$ allele and was wildtype (*dura*) at all other exon 1 nucleotide positions, while the other was heterozygous for the sh$^{AVROS}$ allele (sh$^{AVROS}$/Sh$^{DeliDura}$) and was wildtype (*dura*) at all other exon 1 nucleotide positions. None of the Nigeria palms in this study were phenotyped as *dura*.

Of 2 Tanzania palms phenotyped as *tenera*, 1 was heterozygous for sh$^{AVROS}$ allele (sh$^{AVROS}$/Sh$^{DeliDura}$) and was

TABLE 4

Determination of SHELL exon 1 genotypes in germplasm collections.

| | Sequenced | AVROS | MPOB | Allele 3 | Allele 4 | Allele 5 | Allele 6 | Allele 7 | Allele 8 | Allele 9 | Allele 10 | Allele 11 |
|---|---|---|---|---|---|---|---|---|---|---|---|---|
| Angola | 64 | 50 | 5 | — | — | — | — | — | — | — | — | 2 |
| Ghana | 28 | 10 | 5 | — | 1 | — | — | — | 4 | 4 | 1 | — |
| Nigeria | 27 | 6 | 19 | — | — | — | — | 1 | — | — | — | — |
| Tanzania | 27 | 22 | — | — | — | — | 4 | — | — | — | — | — |
| Guinea | 2 | — | — | — | 2 | — | — | — | — | — | — | — |

Among the palms sequenced as part of the germplasm collection, 32 were visually phenotyped for oil palm fruit type (*dura*, *tenera* or *pisifera*). Of three Angola palms phenotyped as *tenera*, two were heterozygous for the sh$^{AVROS}$ allele and were wildtype (*dura*) at all other exon 1 nucleotide positions within exon 1. Of two Angola palms phenotyped as *dura*, both were heterozygous for the Allele 11 variant (Allele 11/Sh$^{DeliDura}$) and were wildtype (*dura*) at all other exon 1 nucleotide positions, consistent with the expectation that the synonymous change is not directly involved in the *tenera/pisifera* phenotype. One Angola palm phenotyped as *tenera* was wildtype (*dura*) at all exon 1 nucleotide positions. None of the Angola palms in this study were phenotyped as *pisifera*.

wildtype (*dura*) at all other exon 1 nucleotide positions, while the other was a compound heterzygote with the shAVROS allele on one chromosome and Allele 6 on the other chromosome (sh$^{AVROS}$/Allele 6) and was wildtype (*dura*) at all other exon 1 nucleotide positions. Furthermore, 3 of 3 Tanzania palms phenotyped as *dura* were heterozygous for Allele 6. This suggests that although Allele 6 may not contribute to the *tenera* phenotype, it may be a marker for closely linked alleles that do contribute to the phenotype. No Tanzania palms in this study were phenotyped as *pisifera*.

Of 2 Guinea palms phenotyped as *tenera*, 1 was heterozygous for Allele 4 (Allele 4/Sh$^{DeliDura}$) and was wildtype (*dura*) at all other exon 1 nucleotide positions. The other was homozygous for Allele 4 and was wildtype (*dura*) at all other exon 1 nucleotide positions. None of Guinea palms in this study were phenotyped as *dura* or *pisifera*.

REFERENCES

Beimaert, A. and Vanderweyen, R. 1941. Contribution a l'etude genetique et biometrique des varieties *d'Elaeis guineensis* Jacq. Publs. INEAC, Series Ser. Sci. (27):101.

Bhasker, S. & Mohankumar, C. Association of lignifying enzymes in shell synthesis of oil palm fruit (*Elaeis guineensis—dura* variety). 2001. *Indian J Exp Biol* 39: 160-4.

Billotte, N., Marseillac, N., Risterucci, A. M., Adon, B., Brotteir, P., Baurens, F. C., Singh, R., Herran, A., Asmady, H., Billot, C., Amblard, P Durrand-Gasselin, T., Courtois, B., Asmono, D., Cheah, S. C., Rohde, W and Charrier, A. 2005. Microsatellite-based high density linkage map in oil palm (*Elaeis guineensis* Jacq.). Theoretical and Applied Genetics 110: 754-765.

Birchler, J. A., Auger, D. L. & Riddle, N. C. 2003. In search of the molecular basis of heterosis. *Plant Cell* 15: 2236-9.

Cheah, S. C. 1996. Restriction Fragment Length Polymorphism (RFLP) in Oil Palm. Project Completion Report No. 0011/95, 4 Jul. 1996, Malaysian Palm Oil Board (MPOB), Bangi, Malaysia.

Cheah, S. C. and Rajinder, S. 1998. Gene expression during flower development in the oil palm. Project Completion Report No. 0057/98, 16 Jul. 1999. Palm Oil Research Institute of Malaysia (PORIM), Bangi, Malaysia.

Corley, R. H. V. and Tinker, P. B. 2003. Care and maintenance of oil palms. In *The Oil Palm* (4$^{th}$ edition), pp:287-326. Oxford: Blackwell Science.

Danielsen, F. et al. 2009. Biofuel plantations on forested lands: double jeopardy for biodiversity and climate. *Conserv Biol* 23: 348-58.

Devuyst, A. 1953. Selection of the oil palm (*Elaeis guineensis*) in Africa. *Nature* 172: 685-686.

Dinneny, J. R. and Yanofsky, M. F. 2005. Drawing lines and borders: how the dehiscent fruit of *Arabidopsis* is patterned. *Bioessays* 27: 42-9.

Donough, C. R. and Law, I. H. 1995. Breeding and selection for seed production at Pamol Plantations Sdn Bhd and early performance of Pamol D×P. *Planter* 71:513-530.

Doyle, J. J. and Doyle, J. L. 1990. Isolation of plant DNA from fresh tissue. *FOCUS* 12:13-15.

Ferrandiz, C., Liljegren, S. J. & Yanofsky, M. F. 2000. Negative regulation of the SHATTERPROOF genes by FRUITFULL during *Arabidopsis* fruit development. *Science* 289: 436-8.

Godding, R. 1930. Observation de la production de palmiers selectionnes a Mongana (Equateur). *Bull Arig. Congo belge* 21: 1263.

Gschwend, M. et al. 1996. A locus for Fanconi anemia on 16q determined by homozygosity mapping. *Am J Hum Genet* 59: 377-84.

Gu, Q., Ferrandiz, C., Yanofsky, M. F. & Martienssen, R. 1998. The FRUITFULL MADS-box gene mediates cell differentiation during *Arabidopsis* fruit development. *Development* 125: 1509-17.

Gramzow, L. and Theissen, G. 2010. A hitchhiker's guide to the MADS world of plants. *Genome Biology* 11: 214-225.

Hardon, J. J., Rao, V., and Rajanaidu, N. 1985. A review of oil palm breeding. In Progress in Plant Breeding, ed G. E. Rusell, pp 139-163, Butterworths, UK.

Hartley, C. W. S. 1988. The botany of oil palm. In *The oil palm* (3$^{rd}$ edition), pp:47-94, Longman, London.

Huang, H., Tudor, M., Su, T., Zhang, Y., Hu, Y., and Ma, H. 1996. DNA binding properties of two *Arabidopsis* MADS domain proteins: Binding Consensus and Dimer Formation. *The Plant Cell* 8: 81-94.

Imminck, R. G., Gadella, T. W. J., Ferrario, S., Busscher, M., and Angenent, G. 2002. *Proc. Natl. Acad. Sci.* 99: 2416-2421.

Imminck, R. G., Kaufmann, K. & Angenent, G. C. 2010. The 'ABC' of MADS domain protein behaviour and interactions. *Semin Cell Dev Biol* 21: 87-93.

Jack, P. L., James, C., Price, Z., Rance, K., Groves, L., CorleY, R. H. V., Nelson, S and Rao, V. 1998. Application of DNA markers in oil palm breeding. In: 1998 International Oil Palm Congress-Commodity of the past, today and future, Sep. 23-25, 1998, Bali, Indonesia.

Krieger, U., Lippman, Z. B. & Zamir, D. 2010. The flowering gene SINGLE FLOWER TRUSS drives heterosis for yield in tomato. *Nat Genet* 42: 459-63.

Lander, E. S. and Botstein, D. 1987. Homozygosity mapping: a way to map human recessive traits with the DNA of inbred children. *Science* 236: 1567-70.

Latiff, A. 2000. The Biology of the Genus *Elaeis*. In: *Advances in Oil Palm Research,* Volume 1, ed. Y. Basiron, B. S. Jalani, and K. W. Chan, pp:19-38, Malaysian Palm Oil Board (MPOB).

Liljegren, S. J., Ditta, G. S., Eshed, Y., Savidge, B., Bowman, J. L., Yanofsky, M. F. 2000. SHATTERPROOF MADS-box genes control seed dispersal in *Arabidopsis*. *Nature* 404: 766-770.

Maria, M., Clyde, M. M. and Cheah, S. C. 1995. Cytological analysis of *Elaeis guineensis* (*tenera*) chromosomes. *Elaeis* 7:122-134.

Mayes, S., Jack, P. L., Marshall, D. F. and Corley, R. H. V. 1997. Construction of a RFLP genetic linkage map for oil palm (*Elaeis guineensis* Jacq.). *Genome* 40:116-122.

Moretzsohn, M. C., Nunes, C. D. M., Ferreira, M. E. and Grattapaglia, D. 2000. RAPD linkage mapping of the shell thickness locus in oil palm (*Elaeis guineensis* Jacq.). *Theoretical and Applied Genetics* 100:63-70.

Ooijen, J. W. V. 2006. JoinMap 4.0: Software for calculation of genetic linkage maps. In experimental populations. Kyazma B. V., Wageningen, Netherlands Pinyopich, A. et al. 2003. Assessing the redundancy of MADS-box genes during carpel and ovule development. *Nature* 424: 85-8.

Purseglove, J. W. 1972. Tropical Crops. Monocotyledons. Longman, London. pp:607.

Rajanaidu, N., Rao, V., Abdul Halim, H. & A. S. H., O. 1989. Genetic resources: New developments in Oil Palm breeding. *Elaeis* 1: 1-10.

Rajanaidu, N. 1990. Major developments in oil palm (*Elaeis guineensis*) breeding. In Proceedings of the 12$^{th}$ Plenary Meeting of AETFAT, pp: 39-52. Hamburg, Germany.

Rajanaidu, N. et al. 2000. in *Advances in Oil Palm Research* (eds. Basiron, Y., Jalani, B. S. & Chan, K. W.) 171-237 (Malaysian Palm Oil Board (MPOB), Bangi, Selangor).

Sambrook, J., Fritsch, E. F. and Maniatis, T. 1989. Molecular cloning: A Laboratory manual, (2$^{nd}$ edition). Cold Spring Harbor Laboratory Press, Cold Spring Harbor, N.Y.

Singh R, Tan S G, Panandam J M, Rahman R A, Ooi L C L, Low E T L, Sharma M, Jansen J and Cheah S C. 2009. Mapping quantitative trait loci (QTLs) for fatty acid composition in an interspecific cross of oil palm. *BMC Plant Biology* 9: 114.

Sousa, J., Barata, A. V., Sousa, C., Casanova, C. C. and Vicente, L. 2011. Chimpanzee oil-palm use in southern Cantanhez National Park, Guinea-Bissau. *Am J Primatol* 73: 485-97.

Tani, E., Polidoros, A. N. & Tsaftaris, A. S. Characterization and expression analysis of FRUITFULL- and SHATTERPROOF-like genes from peach (*Prunus persica*) and their role in split-pit formation. 2007. *Tree Physiol* 27: 649-59.

Vrebalov, J., Pan, I. L., Arroyo, A. J. M., McQuinn, R., Chung, M., Poole, M., Rose, J., Seymour, G., Grandillo, S., Giovannoni, J., and Irish, V. F. 2009. Fleshy fruit expansion and ripening are regulated by the tomato SHATTERPROOF gene TAGL1. *The Plant Cell* 21: 3041-3062.

Whitmore, T. C. 1973. The Palms of Malaya. Longmans, Malaysia, pp:56-58.

The term "a" or "an" is intended to mean "one or more." The term "comprise" and variations thereof such as "comprises" and "comprising," when preceding the recitation of a step or an element, are intended to mean that the addition of further steps or elements is optional and not excluded. All patents, patent applications, and other published reference materials cited in this specification are hereby incorporated herein by reference in their entirety.

```
INFORMAL LISTING OF EXEMPLARY SEQUENCES
SHELL predicted protein sequence, mutation
underlined, italicized, and bold [pisifera,
Zaire allele; sh^AVROS]
                                       SEQ ID NO: 1
MGRGKIEIKRIENTTSRQVTFCKRRNGLLKNAYELSVLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence mutation
underlined, italicized, and bold [pisifera,
Nigerian allele; sh^MPOB]
                                       SEQ ID NO: 2
MGRGKIEIKRIENTTSRQVTFCKRRNGLPKKAYELSVLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence mutation
underlined, italicized, and bold [predicted
pisifera, Allele 3]
                                       SEQ ID NO: 3
MGRGKIEIKRIENTTSRQVTFCQRRNGLLKKAYELSVLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence mutation
underlined, italicized, and bold [predicted
pisifera, Allele 4]
                                       SEQ ID NO: 4
MGRGKIEIKRIENTTSRQVTFCKRRNGLLKKAYELSVLCDDEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence mutation
underlined, italicized, and bold [predicted
pisifera, Allele 5]
                                       SEQ ID NO: 5
MGRGKIEIKRIENTTSRQVTFCNRRNGLLKKAYELSVLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence mutation
underlined, italicized, and bold [predicted
pisifera, Allele 6]
                                       SEQ ID NO: 6
MGRGKIEIKRIQNTTSRQVTFCKRRNGLLKKAYELSVLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence deleted amino
acids indicated by a dash ("-") [predicted
pisifera, Allele 7]
                                       SEQ ID NO: 7
MGRGKIE-----NTTSRQVTFCKRRNGLLKKAYELSVLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence mutation
underlined, italicized, and bold [predicted
pisifera, Allele 8]
                                       SEQ ID NO: 8
MGRGKIEIKRIENTTSRQVTFCKHRNGLLKKAYELSVLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence mutation
underlined, italicized, and bold [predicted
pisifera, Allele 9]
                                       SEQ ID NO: 9
MGRGKIEIKRIENTTSRQVTFCKGRNGLLKKAYELSVLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence mutation
underlined, italicized, and bold [predicted
pisifera, Allele 10]
                                       SEQ ID NO: 10
MGRGKIEIKRIENTTSRQVTFCKRRNGLLKKAYELSDLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SHELL predicted protein sequence, silent mutation
results in wildtype amino acid sequence [predicted
pisifera, Allele 11]
                                       SEQ ID NO: 11
MGRGKIEIKRIENTTSRQVTFCKRRNGLLKKAYELSVLCDAEVALIVFSS

RGRLYEYANNSIRSTIDRYKKACANSSNSGATIEINSQYYQQESAKLRHQ
```

IQILQNANRHLMGEALSTLTVKELKQLENRLERGITRIRSKKHELLFAEI

EYMQKREVELQNDNMYLRAKIAENERAQQAA

Deletion in intron 1 of SHELL gene, deleted
nucleotides in reference to wild-type denoted with
a dash ("-")

SEQ ID NO: 12
GTATGCTTTGATGACGCCTTCTCTTCCTTCGCTCATATCAAG----

TTTTATGGCTTCA T

SHELL Exon 1 Sequence of Allele 3, mutation
underlined, italicized, and bold

SEQ ID NO: 13
ATGGGTAGAGGAAAGATTGAGATCAAGAGGATCGAGAACACCACAAGCCG

GCAGGTCACTTTCTGC*C*AACGCCGAAATGGACTGCTGAAGAAAGCTTATG

AGTTGTCTGTCCTTTGTGATGCTGAGGTTGCCCTTATTGTCTTCTCCAGC

CGGGGCCGCCTCTATGAGTACGCCAATAACAG

SHELL Exon 1 Sequence of Allele 4, mutation
underlined, italicized, and bold

SEQ ID NO: 14
ATGGGTAGAGGAAAGATTGAGATCAAGAGGATCGAGAACACCACAAGCCG

GCAGGTCACTTTCTGCAAACGCCGAAATGGACTGCTGAAGAAAGCTTATG

AGTTGTCTGTCCTTTGTGATG*A*TGAGGTTGCCCTTATTGTCTTCTCCAGC

CGGGGCCGCCTCTATGAGTACGCCAATAACAG

SHELL Exon 1 Sequence of Allele 5, mutation
underlined, italicized, and bold

SEQ ID NO: 15
ATGGGTAGAGGAAAGATTGAGATCAAGAGGATCGAGAACACCACAAGCCG

GCAGGTCACTTTCTGCAA*T*CGCCGAAATGGACTGCTGAAGAAAGCTTATG

AGTTGTCTGTCCTTTGTGATGCTGAGGTTGCCCTTATTGTCTTCTCCAGC

CGGGGCCGCCTCTATGAGTACGCCAATAACAG

SHELL Exon 1 Sequence of Allele 6, mutation
underlined, italicized, and bold

SEQ ID NO: 16
ATGGGTAGAGGAAAGATTGAGATCAAGAGGATC*C*AGAACACCACAAGCCG

GCAGGTCACTTTCTGCAAACGCCGAAATGGACTGCTGAAGAAAGCTTATG

AGTTGTCTGTCCTTTGTGATGCTGAGGTTGCCCTTATTGTCTTCTCCAGC

CGGGGCCGCCTCTATGAGTACGCCAATAACAG

SHELL Exon 1 Sequence of Allele 7, deleted
nucleotides in reference to wild-type denoted
by a dash ("-")

SEQ ID NO: 17
ATGGGTAGAGGAAAGATTGAGA---------------ACACCACAAGCCG

GCAGGTCACTTTCTGCAAACGCCGAAATGGACTGCTGAAGAAAGCTTATG

AGTTGTCTGTCCTTTGTGATGCTGAGGTTGCCCTTATTGTCTTCTCCAGC

CGGGGCCGCCTCTATGAGTACGCCAATAACAG

SHELL Exon 1 Sequence of Allele 8, mutation
underlined, italicized, and bold

SEQ ID NO: 18
ATGGGTAGAGGAAAGATTGAGATCAAGAGGATCGAGAACACCACAAGCCG

GCAGGTCACTTTCTGCAAA*C*ACCGAAATGGACTGCTGAAGAAAGCTTATG

AGTTGTCTGTCCTTTGTGATGCTGAGGTTGCCCTTATTGTCTTCTCCAGC

CGGGGCCGCCTCTATGAGTACGCCAATAACAG

SHELL Exon 1 Sequence of Allele 9, mutation
underlined, italicized, and bold

SEQ ID NO: 19
ATGGGTAGAGGAAAGATTGAGATCAAGAGGATCGAGAACACCACAAGCCG

GCAGGTCACTTTCTGCAAA*G*GCCGAAATGGACTGCTGAAGAAAGCTTATG

AGTTGTCTGTCCTTTGTGATGCTGAGGTTGCCCTTATTGTCTTCTCCAGC

CGGGGCCGCCTCTATGAGTACGCCAATAACAG

SHELL Exon 1 Sequence of Allele 10, mutation
underlined, italicized, and bold

SEQ ID NO: 20
ATGGGTAGAGGAAAGATTGAGATCAAGAGGATCGAGAACACCACAAGCCG

GCAGGTCACTTTCTGCAAACGCCGAAATGGACTGCTGAAGAAAGCTTATG

AGTTGTCTG*A*CCTTTGTGATGCTGAGGTTGCCCTTATTGTCTTCTCCAGC

CGGGGCCGCCTCTATGAGTACGCCAATAACAG

SHELL Exon 1 Sequence of Allele 11, mutation
underlined, italicized, and bold

SEQ ID NO: 21
ATGGGTAGAGGAAAGATTGAGATCAAGAGGATCGAGAACACCACAAGCCG

GCAGGTCACTTTCTGCAAACGCCGAAATGGACTGCTGAAGAAAGCTTATG

AGTTGTCTGTCCT*C*TGTGATGCTGAGGTTGCCCTTATTGTCTTCTCCAGC

CGGGGCCGCCTCTATGAGTACGCCAATAACAG

SHELL Exon 1 Sequence of sh$^{AVROS}$ Allele, mutation
underlined, italicized, and bold

SEQ ID NO: 22
ATGGGTAGAGGAAAGATTGAGATCAAGAGGATCGAGAACACCACAAGCCG

GCAGGTCACTTTCTGCAAACGCCGAAATGGACTGCTGAAGAA*T*GCTTATG

AGTTGTCTGTCCTTTGTGATGCTGAGGTTGCCCTTATTGTCTTCTCCAGC

CGGGGCCGCCTCTATGAGTACGCCAATAACAG

SHELL Exon 1 Sequence of sh$^{MPOB}$ Allele, mutation
underlined, italicized, and bold

SEQ ID NO: 23
ATGGGTAGAGGAAAGATTGAGATCAAGAGGATCGAGAACACCACAAGCCG

GCAGGTCACTTTCTGCAAACGCCGAAATGGACTGC*C*GAAGAAAGCTTATG

AGTTGTCTGTCCTTTGTGATGCTGAGGTTGCCCTTATTGTCTTCTCCAGC

CGGGGCCGCCTCTATGAGTACGCCAATAACAG

Wild-type SHELL (Sh$^{DeliDura}$) predicted protein
sequence. Amino acids mutated in sh$^{AVROS}$, sh$^{MPOB}$,
and alleles 3-6 and 8-10 are underlined,
italicized, and bold. Amino acids mutated in
allele 7 are underlined.
[dura, Sh$^{DeliDura}$]

SEQ ID NO: 24
MGRGKIEIKRIENTTSRQVTFCKRRNGLLKKAYELSVICDAE

VALIVFSSRGRLYEYANNSIRSTIDRYKKACANSSNSGATIEINSQYYQQE

SAKLRHQIQILQNANRHLMGEALSTLTVKELKQLENRLERGITRIRSKKHE

LLFAEIEYMQKREVELQNDNMYLRAKIAENERAQQAA

Wild-type SHELL (Sh$^{DeliDura}$) Exon 1 Sequence,
nucleotides mutated in sh$^{AVROS}$, sh$^{MPOB}$, and
alleles 3-6 and 8-11 are underlined, italicized,
and bold. Nucleotides deleted in allele 7 are
underlined

SEQ ID NO: 25
ATGGGTAGAGGAAAGATTGAGA*TCAAGAGGATCG*AGAACACCACAAGCCG

GCAGGTCACTTTCTGC*AAACG*CCGAAATGGACTGC*T*GAAGAA*A*GCT

-continued

```
TATGAGTTGTCTGTCCTTTGTGATGCTGAGGTTGCCCTTATTGTCTT

CTCCAGCCGGGGCCGCCTCTATGAGTACGCCAATAACAG

Wild-type SHELL (Sh^DeliDura) Exon 1 merged with
nucleotides 1-119 of intron 1
                                       SEQ ID NO: 26
ATGGGTAGAGGAAAGATTGAGATCAAGAGGATCGAGAACACCACAAGCCG

GCAGGTCACTTTCTGCAAACGCCGAAATGGACTGCTGAAGAAAGCTTATG
```

-continued

```
AGTTGTCTGTCCTTTGTGATGCTGAGGTTGCCCTTATTGTCTTCTCCAGC

CGGGGCCGCCTCTATGAGTACGCCAATAACAGGTATGCTTTGATGACGCC

TTCTCTTCCTTCGCTCATATCAAGTTAATTTTATGGCTTCATTTGTTCTA

TGGCCAAGCCAAATTCTTTTTAAAGTTCTAGAATGTTAATGATGGTAGTT

T
```

SEQUENCE LISTING (33 sequences)

SEQ ID NO: 1 - protein, 181 aa, Elaeis guineensis
MGRGKIEIKRIENTTSRQVTFCKRRNGLLKNAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 2 - protein, 181 aa, Elaeis guineensis
MGRGKIEIKRIENTTSRQVTFCKRRNGLPKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 3 - protein, 181 aa, Elaeis guineensis
MGRGKIEIKRIENTTSRQVTFCQRRNGLLKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 4 - protein, 181 aa, Elaeis guineensis
MGRGKIEIKRIENTTSRQVTFCKRRNGLLKKAYELSVLCDDEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 5 - protein, 181 aa, Elaeis guineensis
MGRGKIEIKRIENTTSRQVTFCNRRNGLLKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 6 - protein, 181 aa, Elaeis guineensis
MGRGKIEIKRIQNTTSRQVTFCKRRNGLLKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 7 - protein, 176 aa, Elaeis guineensis
MGRGKIENTTSRQVTFCKRRNGLLKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 8 - protein, 181 aa, Elaeis guineensis
MGRGKIEIKRIENTTSRQVTFCKHRNGLLKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 9 - protein, 181 aa, Elaeis guineensis
MGRGKIEIKRIENTTSRQVTFCKGRNGLLKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 10 - protein, 181 aa, Elaeis guineensis
MGRGKIEIKRIENTTSRQVTFCKRRNGLLKKAYELSDLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 11 - protein, 181 aa, Elaeis guineensis
MGRGKIEIKRIENTTSRQVTFCKRRNGLLKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 12 - DNA, 56 bp, Elaeis guineensis
gtatgctttgatgacgccttctcttccttcgctcatatcaagttttatggcttcat

SEQ ID NO: 13 - DNA, 182 bp, Elaeis guineensis
atgggtagaggaaagattgagatcaagaggatcgagaacaccacaagccggcaggtcactttctgccaacgccgaaatggactgctgaagaaagcttatgagttgtctgtcctttgtgatgctgaggttgcccttattgtcttctccagccggggccgcctctatgagtacgccaataacag

SEQ ID NO: 14 - DNA, 182 bp, Elaeis guineensis
atgggtagaggaaagattgagatcaagaggatcgagaacaccacaagccggcaggtcactttctgcaaacgccgaaatggactgctgaagaaagcttatgagttgtctgtcctttgtgatgatgaggttgcccttattgtcttctccagccggggccgcctctatgagtacgccaataacag

SEQ ID NO: 15 - DNA, 182 bp, Elaeis guineensis
atgggtagaggaaagattgagatcaagaggatcgagaacaccacaagccggcaggtcactttctgcaatcgccgaaatggactgctgaagaaagcttatgagttgtctgtcctttgtgatgctgaggttgcccttattgtcttctccagccggggccgcctctatgagtacgccaataacag

SEQ ID NO: 16 - DNA, 182 bp, Elaeis guineensis
atgggtagaggaaagattgagatcaagaggatccagaacaccacaagccggcaggtcactttctgcaaacgccgaaatggactgctgaagaaagcttatgagttgtctgtcctttgtgatgctgaggttgcccttattgtcttctccagccggggccgcctctatgagtacgccaataacag

SEQ ID NO: 17 - DNA, 167 bp, Elaeis guineensis
atgggtagaggaaagattgagaacaccacaagccggcaggtcactttctgcaaacgccgaaatggactgctgaagaaagcttatgagttgtctgtcctttgtgatgctgaggttgcccttattgtcttctccagccggggccgcctctatgagtacgccaataacag

SEQ ID NO: 18 - DNA, 182 bp, Elaeis guineensis
atgggtagaggaaagattgagatcaagaggatcgagaacaccacaagccggcaggtcactttctgcaaacaccgaaatggactgctgaagaaagcttatgagttgtctgtcctttgtgatgctgaggttgcccttattgtcttctccagccggggccgcctctatgagtacgccaataacag

SEQ ID NO: 19 - DNA, 182 bp, Elaeis guineensis
atgggtagaggaaagattgagatcaagaggatcgagaacaccacaagccggcaggtcactttctgcaaaggccgaaatggactgctgaagaaagcttatgagttgtctgtcctttgtgatgctgaggttgcccttattgtcttctccagccggggccgcctctatgagtacgccaataacag

SEQ ID NO: 20 - DNA, 182 bp, Elaeis guineensis
atgggtagaggaaagattgagatcaagaggatcgagaacaccacaagccggcaggtcactttctgcaaacgccgaaatggactgctgaagaaagcttatgagttgtctgacctttgtgatgctgaggttgcccttattgtcttctccagccggggccgcctctatgagtacgccaataacag

SEQ ID NO: 21 - DNA, 182 bp, Elaeis guineensis
atgggtagaggaaagattgagatcaagaggatcgagaacaccacaagccggcaggtcactttctgcaaacgccgaaatggactgctgaagaaagcttatgagttgtctgtcctctgtgatgctgaggttgcccttattgtcttctccagccggggccgcctctatgagtacgccaataacag

SEQ ID NO: 22 - DNA, 182 bp, Elaeis guineensis
atgggtagaggaaagattgagatcaagaggatcgagaacaccacaagccggcaggtcactttctgcaaacgccgaaatggactgctgaagaatgcttatgagttgtctgtcctttgtgatgctgaggttgcccttattgtcttctccagccggggccgcctctatgagtacgccaataacag

SEQ ID NO: 23 - DNA, 182 bp, Elaeis guineensis
atgggtagaggaaagattgagatcaagaggatcgagaacaccacaagccggcaggtcactttctgcaaacgccgaaatggactgccgaagaaagcttatgagttgtctgtcctttgtgatgctgaggttgcccttattgtcttctccagccggggccgcctctatgagtacgccaataacag

SEQ ID NO: 24 - protein, 181 aa, Elaeis guineensis; identical to SEQ ID NO: 11

SEQ ID NO: 25 - DNA, 182 bp, Elaeis guineensis
atgggtagaggaaagattgagatcaagaggatcgagaacaccacaagccggcaggtcactttctgcaaacgccgaaatggactgctgaagaaagcttatgagttgtctgtcctttgtgatgctgaggttgcccttattgtcttctccagccggggccgcctctatgagtacgccaataacag

SEQ ID NO: 26 - DNA, 301 bp, Elaeis guineensis
atgggtagaggaaagattgagatcaagaggatcgagaacaccacaagccggcaggtcactttctgcaaacgccgaaatggactgctgaagaaagcttatgagttgtctgtcctttgtgatgctgaggttgcccttattgtcttctccagccggggccgcctctatgagtacgccaataacaggtatgctttgatgacgccttctcttccttcgctcatatcaagttaattttatggcttcatttgttctatggccaagccaaattctttttaaagttctagaatgttaatgatggtagttt

SEQ ID NO: 27 - DNA, 3391739 bp, Elaeis guineensis (residues 1-1,695,870 of 3,391,739)
  misc_feature (1)..(3391739): n = a, t, c or g
ggatcgtttgcacggttgctcagggtcagtcggtatatcagtcggtatatcccaacagttgcccccccactcctgagcctgatatcacgtcagctcgcatttccacgcaggtgcggcgtcgggcgaaaggagtggatctttattacatcatgccctgatcctgctgatctcaccaacggacgatccggacaaatcggcgtcagacgacttgatgtctgatgatccgatgtcagacgatccggtgtcagacgatccgatgtcagacatcctctggggaacgcagaccaccgtctggcgctcctttaggagtgcagaccgtcgtcaggcatcccatcgggaatgcggaccaccgtcagcgaattaattctgaggcgcggttcttccgccacgtgtcgggaggtcgttgggccggagtcgttcgcgtggatgaaggtgacgtggcccgatctgggatgggtgcgtcgaatcgtcgggccggaggagggcccggatgctgccacatgtcaatcatccgagaggtcctcgtcggcgtgccctcatcccgaccgtcgaggggccctatatatatggtgtcacttgtatccaaaaccttatttttcgtggttctgctgtagagactctgcccgaggggtcccccttgtcccaggtagttgcttctgctcccattccttgagaagtcccttcgagacttttgtctcctttcgccttctccttgcttcttttggaattctctccccttcttcttcttctccatcttttccttcttcctggttctggcgtcatggtcaggacttctcctcggggagctcagtcggagaatccgactgatgatcttcggtcgaccccggaggtggaggcctcttcactttcgaggccgaatgtcgatcggcttcgggatcagtactgtatcccggagcagttccgactcttcacccctggggccgggggatgggtctacaacccgcccgcgggtcaggtggctctgtatgtcgaggaccttcgggccggtcttcatctcctgattctggagtttgtccggaactttctggattactacggactttgtccggtgcaactggcgccgaactcagttcggttaataatcagttttgctctgttgtgtcagcttttgccgaccaaccctcggatctctctcttccgggcgttcttcatcctccgaccccaccctaaagcccaaggatggtggctcttcaatcctcgaaagggtctctctttcatcactggtcttccatcgtccattcatgggtagaagaatcagttcttctttgtttcttcttcctctccttgggggtttccttcccactggggcgagcctctgactgggccgaacgagaacagccgagtggaggcagatgatcggaaggatttctaccgacttaaggacatgtcggtaccgaagcagagggagcttgttaccgaacaagccctctatgatgccggtctgagcctggtcccccgtctaggtactgtccggtccatcgattgtcttttcgcttctcgtttgtccccgaacacgtactgattctcttattgaaattgtaggtacgtcatcgaggatgagaccgacagatgccgagatcagacaatatgcagcgaggaagaggctggcgtctggggccgggccctcacgcctgtcgaaaaggtctcagatgttgcccccgaccgtcactgcatcgacggccgatcagtcggagccgatcatcgcgctctcgatgccggcagtgccatcaggggagcagccggtggagggaatggccgaaggagcgtcggcggcgtcgccgatggaggaggcccggggtgatgctcgggagcccgagcatccttcatcggctcccgttgctgcctcgaggggagctcaatcgagttcgtgcctcccctccttccccaatctacgggcctgggcggcgggtcgggggaaggccccgatggcccacgcgggcgactcaaggtcgggggaccgcgtcgggtcgtcgggtgcccggattccttagggagcgtcagtcctggccgaccatgacttggccaggagattatgccaggggaccctccttccagccgacctggaggtcctgaagactcgacgggtgaccgagatgctgtcttccttttacccgaccatgatcggggtaagttctaccttgccttctttcttcattgttgcctttactattctatctttctaacggtcggcttctgcttgcagttgatttacaccatgtccaagttagaggccggataccagaagttcgaagacgtccgggcggcctggaaggacaaggcaatgaccgtcgaagccgagaaggcggtgctgatcgaacagctgaagctgtcgaccgatcgggaggtgagactggaggatgagatctctcgccttaccgacgctttggctgcctcaagggccgaactcaagtcggtccgcgaggaagccaagcgcaagggtcgaaccgctcaccaattgcggtgcgagcgggatggcatcgtcgccgaacttgaggccgagcgtgagcagctctgggttagcctggagaacctcgccaaggtcgaggaggacttgtcaatcgctcaagccgacactgacatagcgaaggcggagacggaggcaaaatcggcgatggagtcgttaggtcgggcggtggaggacttctacggctccgacaaatatcgagaggagctcctggaaagcagtttcgcatcataccgggtggggtacgaagatgctcaggatgcagtcaaggctttgtacccgaagctcgacctcagcggcattgttcccccaggatcagaggagcaagccatagaagaggtggccgacccatcgtcgggggatcatacagcgatggaggaagccgtcctggagtaggtcgccgaaggggagacagccccgacctccaatccagcgccgacccgagcggacatgccggctgccctcgagcttctcccgattgaagaggtcgactccgaagagtaatcggagttgtttttgtcttgctttatatacttgtaatcgggcttcggcccaattttgtaaactcgatatatttatgagtgaaatcgagaatttttaaactttcttcccttggcatattaagacgcattctgagtcatgtgcttcgccgaagcgctttccaagcatgaagtcgtagacccgtcgtaccttattaggtcactcgctaatatcccaggtcgttagccgagatagtcggtagcgtgcaccacgaaaaaggcgaggcgagtttcgattacagaccagtcattttgacgttcgtaggatgtgaccgtcgaaggcctgagttgaacatccatcgtctggtcgtaaatcgggcgtgtttgtcgagtcgaaggtgaaagccgactgtgcgtcgctcagacgtgagtcgggcgtgttcgtcgagtcgaaggtcgaagccgactgtgcgtcgcccggacatgaatcgggcctgttcgtcgagtcgagggtcgaccaacctccggacatagcccgatgatccgatcattctgtagggtcgaatgtcgtccggtgcgttcagtcggaaggtgtccgacatgttcagtcagaaaaatgatggcaagtcgagtttccattacccagactttggtcgggtacatacgtcgcggtgcgtgataaacggtggtaagccgaatatccttcgaccggtcgtgacctggtcggttggccatgaatgcgacattggtcgcgttggtgtttggcctttcttggccggggccaagtcagcaacttagccaattattttgcccgagagtttgactgtagaaggagtgtgactcccgtcgttgtggatatatcgatcatcgtaagtgtccgatgtgtcgttggcgatcgggccgttgattctcaatggaacgttgggcccaagtcggggcgttggggctcgtactcctggcgagtgccgacccacagtcgaagagtcgagatttcggactccaaagttttgaaactgaatttgtattccggacaaggggatacagagttcactggtagtacaatcttagattgtcggcatttcaagtccgggggatggccgttccttctagggctctagtcggtaggcttccaaccgataggtgtcggctatcttgtagggtccttcccagttcggggataatttcccctggtctagaggcttcgaaacttctgcttttcttaagatcaggtccccggacctgaaaagcttcggcttgaccttggcattgtagtaccgggccaccttttgtcggtaggaagccatacggatctgtgcctcgcatcgaaattcgggcaagaggtctaagtcggctctctgacactcggagttgcccggctcactatactgctcgactctggtcgacggtagcccgatctccagcgggatcattgcttccgtcctgtaggctaagttgaagggagattccctggttgggacatggggcatcgttcggtatgcccataggacagagggcagttcctcaacccagaggcccctagcttcattcagcctgatcttcagtccgtgtagaatggttcgattggtcacttccacctcgtcgttagactttggatgcccgactgaggtcagcctgtgcgctatatgaaatctcgcacagaagtttctgaagttctggttgtcgaattgtcatccattgtcggtgataatgatgttcggcaatccaaacttgaagatgatggacttctggatgaagtcttccatcttccgcttggtgatttacgccagaggtttgacttccacccacttagtgaagtagtcgatcgcgacgactatgaactttcgttggccggacgccgaagggaaaggttcgagtatgtcgattctccactggacgaagggccacggggcgacgacgggagtcagctggctggcgggtcggtgttgtatgttggcatacctttggcatggttcgcacctccgaaccaactcagccgcgtccttcttcatggtgggccagtagtaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcgcaggactttgtaggtcaaggatttgccacccaagtgattaccgcagatcccttcaagcacttctctgagaggcatagtccacgtcggctggccccagacacctcagcaagggaagagagaacgaccttttgtagagtcaaccgtccaccaacacatattgggaagccgcccaccggagttgtttggcttccgcggggtcttcggggctagttccgtcggtcaggtactgaacgatcagatccatccagcacggctcgatcgccagttgtagcacctcctcagtcttgtcgatgcttggttgctcaagactttctacgagcgtccggcccaaagtgccgtagtcggacgtcgcgagcctggagagtgcatcggctcgagcattttttgccctacgaatgtgggagatctcgaaggacttgaagatcgctacgagatctcttactttctgatgatatttggccatggtcagatcccacgctttgaattcgcctttgacctgtccaacgatcagttgagagtcggagaagaccttgaggctgtcgaccccgagctcccgtgccaaccccaagcccgcgataagtgcctcatattcggcttgattattgaaggtcttaaagtcgaatcggagggcatgctcgacaaccactccctccgagttggtgagcaggaacccggccccgcttcctcgagcgttggaagctccgtcgatgtgcaacacccaggttgaatcggggtcatattcggaggtcccaacctcttcggggctcccctttttcgatgctcgatcggtcgtcgggcactccacgataaagtcggccagaacctgagctttcagagcaggtcgcggtcggtactgaatgtcgaactcgctcagtctcacagcccacttcgccaaccatcctgatgtgtcagggtggtgcaggatcgctctcaggggttggtcggtgagaaccacgatagcgtgtgcctggaagtatggatggagcctctgtgctgaaataatcagggcaaatatcattttctccgccatcgagtaccgagtttcggcttcgtggagcactttgttgatgtaatatattggttggtgaactcggttctcgttctctcggacgagcaccgagctaactgcctctggagaggtagccaagtaaagatacagcattttcccgacctccggcctcacaaccaggggcggagaagccaaatatttcttcagttcttcgaaggcccgtcggcactcgtccggccaagagaagtgctttgcttgtctcagggttttgaagaacgggaggcatctctcgaccgatcgagaaatgaaccgactgagcgcgatgatccttccgttgagttgctgcacctcctttttggtgtccggatgccgcatgtctacgattgctttgatcttctcatggttggcctcgatttctcgttgtgaaatgaggaacccaaggaacttctctaaggtcactccgaaggcgcacttagttgggttcagcttcatccgatgtcgtcgtagagtgcagaaggtttcttcgagatcttgcacgtgatctgaagtttgtgcactcttcaccagcatgtcatccacgtacacctccatgttgcgcccgatttggtctttgaagaccttattgacaagtcgctggtaggtagccccggtgttcttcagaccgaaaggcattactcgatagcagtaaaggcccttggcgatcacgaaagccgtatgctcctcgtcctccggtgccatccggatctgattgtatccgacgaaggcatccatgaagctgagcagtcggtagccggatatcgtgtccaccagttggtcgatctttggaagtgggaagctgtccttcggacggcccgattcaagtcggtgtaatcgatgcagatcctccacttcccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagctgccgtcgcccgtggtcgggataattgcgatccgaccctgaccacccgttcagaattttctgttatcgggatggaaactagctgctcggtcggttcaccccgttcctgctcttctcgttgatccagcttgtcgatcggtaaggaatcctcccgcacgtcgctctgagtcaagatttggaagcatcgtcgagcgagctgttgatccccgtgcatctctccaactccatttttagtcgggaactggaccaacagatgatacgtcgagattatcgctctgaaggcatttagtccgggtcttccaagaatggcattgtaagccgaagacacttggacgaccgtgaaagttaagtgggtggtgctttgtcgtggttcggttccgaccgtcacagaaagagtagtttctccttccaccgtgacggcttccccgacgaaacccaccaggagcgtggagactctcttgagccgatcagtagatagtcgcattcgagagaaagtcgagtagaacaaaatgttgatcgaacttctattattgacgagaattctttttacatcataattagctattgttgccgagacaacaacagcgtcatcatgggagtttggattctccggatatcttcatccgtaaaggtaattacattatcctggcgcagcttctttgtcgactctcctgtagcagtcgtcccccgatccgctcatttggagatcatgttgatgaccccggccgttggttagttgttcgccgctttctcagtcggttggggtcgtcggtcggggatgggtcgagtcggcgcgctccgtcggaatttgtcgaggtaccctcatcgtatgagggcctcaatctcatctttgagctggatgtactactccgtgttatggccgtggccctgatggaatcgacagtactttcatcggtcgaggccttttgccttcaaaggtggaggccgccgcagatattcttctccttcgatctccatcaagatctgcgcacgaagagcagaaagaggagtataggagtcatacctgcgatgcatcggcctcgggctccaccatcggggaggtctcgggctcgaccgtcggggagttctcgggctcgaccgtcggggcgagacctgtttgtcggtcggaggaccgctaagctcggcaggggcccgacctttccttcgcttttccttcaggcccttggtctcggtcaggcaccgatcggaagctcctttgtctgcacgcatatatttgtatgcgcattccagcagttcggcgtatgttcgggggagggtcttgtccaaggagtatgtgaatcgggatgccctcagcccccgcttcatggtcgagatagtcatatcttcgttgaggtctcgaacctcaagcgtggctgcgttaaatcgcaccacgaagtgttggagcgtctcgttttctccctgtttgagggagaaaaggctatctgaggttcgtggcggctttcgactggtgctaaaatgggccacgaaagagtgcttgagctgtccgaaggagtagatgattccgaagcgaaggccggagtaccaagtcctggcggctttgcggagcgtggcgggaaagccaatgcagaggagggcgtcggtcgttccttggatcgtcatgagagccttgtagctctctagatggtcgacagggtcggtagagccatcgtaaggctccacatgtggcatcttgaaccgactggagatcggttcgtcgagtatgaatcgggagagggattgggcagtctggaagtcgacgtcgttcgaagacttctaaccatccacctggagctgggcgagccgacgatcgatttcttcgaacctacgctcgtagttgtccatccgtcggtgctgggagactctaggagtcaaatctcccgatgaatccaagagggaggcggacggtgctcgcggccgcttctccttccttgctcgctcgagctgggaaggaaaggggcgctgggaccggcagatgtcacgccgtggcggcctctctccctctcgatgggaatgcggggacagctgctcctgaggaggagacggagatcgacgcaggcgtcggcggctgcccctggacgacatcgggttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagacgaccccgaccagacgaccccgacggacgactccgacggacgaccccgacagatgactctgatgaacgactccgacggacgactccgacagacgaccccgacagatgaccccgacggatgactccgacggacgaccccgacggtcggcgtcgaataccgacatatagtcggtcagcccgtccaaataccgtacaactgctatgggcagttgtcctgtcaaggacatacggcatggccgccctggggcattgtcctaccgaggacatagattaatcccagtgacttgacagcccacgatgacttgacagtccacagcaacttaacagcccccgacgatttgacaactcctcaatcgtctgcaccattaatggcgggaccataccgcattctactataaaacaggataaggcaacggtattggggagttctaaggtccaagtctcgagctccctgaagttcctctaagctctagagctctctctctctcctgttgagcccctaatttttcactattgtctggtctcctctctgacttgaccatcagagggtccccgctgaaggcgtctccggtctgtgaggacttttctcgcaggtgcacgacaccgacgatcgggcgatggggggattggccgcaacaaatttggtgcgccaggaaggggtactcgacagagataggccagcgagctccacacagcttgaaaaacctctcgaaatgatgaaaaccagagctcaacgatcgagagctaccaggtcggcgaggcgttcttcctgttgggaagaggcccctccttcaccctccatggcggagcccagctctccgcatccggtggtaactatggaggtgcaaatcatgacgatcatgcggcaaatgaccgttctgacagatgcggtcaaaaatctccaacagcaaccgactcagttgccgcaaccgtcggtggtgcaccatatgccatccagaagcagccgtcgacgcctgcgtcaactcctgtctcctcttcaagagcagccgtcttagcactcccaccgagaaggagcgaggcagtcgcagcgtgacacccaccgatctcgatgtccttctccttcccagttggagcgggcgaggaaggagaagcggccgcggataccgtccgcctcactctcaagttcctcgagaggttcaacccctggggtctcaccgcaccgacggctggacgactacgaacgtaagtttaaagaaattgaccgtcggcttgtctagctctaggtggatggttagaagtcttcgaacgacgtcgacttccagaccgcccaacctctctcccgacttatcctcgataaaccatttcctagtcggttcaagatacctcatgtagagcgttacgatggctccaccgacctagttgaccatctggagagctacaaggctctcatgacaatctagggggcaaccaatttcctcctctgcatcggcttccccgtcatgctttgtaaagctgtcagggcctggtactccgacctccgctcggagagtatccactcctttggacagctcgagcattctttcgtggcccacttcagcaccagccggaagctgccgcaaatctcggatagtcttttctccctcaaacagggagaaaacgagacgctctgacactttgtggcccgattcaacacggccacacttgaggtccgggacctcaacgaagatatggctatcccgatcatgaagagaggactaagggggtcccgattcacctattccttggacaagaccctcccctggacgtatgtcgagctgctagagcgcgcgtataaatacatgcgcatggacgaaggagcttccgactggcgcctgaccgagggcacgggtcagaaggagaagcgaaagaaaaatcaggctcctgttgaccacagcgggccccaccgatagatgggtctcgtcccgataatggagtctgagaccgacgcatcgcaggtatgactcctacacccctctctccgctcctcgtgtgcagatcctgatagagatcgaagaagcggagtatctacgacggcctcggcctctgaaggcaaaggatctcgaccaacataacccgatcgccaatcgtcgaatccacggctcaattatcgatcgccgaaccgacggcctcggcctctgaaggcaaagggcctcaaccaaagtggctcgatcgtcgatcgtcgaatctatggctcgatcgtcgatcgccgaatctacgacccgatcatcgatcgcggaatccatggctcgatcgtcgaatctacgacggcctcggcttctgaaggcaaaaggccttgaccaatgcgatccgatcgccgaatctatggctcgatcatcaattgccaaatctacggcccgatcgtcgaaccgagggcctcagcctctgaaggcaaagggcctcgaccaatgcgacccgattgtcaaacctatggctcgatcatcgatcgccaaatctatgatccgatcgccgaactgacggcctcggcctctgaaggcaaagggcctcgaccaacgtggcccgatcgtcgatcgccgaaccaacggctcgatcgccgaccaacatgacccgatcatcaatcatcgaatacacagcttgatcgccgatcatcgaatcaatacggctcgatcgtcgatcgtcgaatccatggctcaatcgtcgattgccgaaccgacggcctccgcctctgagggtaaaaggtctcgaccaacgcggctggctaacttgctaacttagcttcgactaagaagggcaaaatgttaggatgaccgcagtcgtgctcgcgacataccgacttggtcacgaccagtcgaatgatattcggcttgccaccgtttatcatgctccatgacgtacccgcccgaccaaggtccgggcaacgggtatttgacttgcgacacaccgactatcaagttctacgacagagatcgaatgggtggaatatctacgacggcctccatctctgaaggcaaaaggcctcaaccaatgccgctggctaacttgccgacttagcttcgactaagagcggcaaaatgccaagacgacagtagttcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgttactcgactatcggatacgtcggatgctactcgactatcagactcaacgggatgatcgtgtcatgctacgttcggaggttggccgacctccgacccaacgtgcacgctcgacctatagtcgggacgaccgacatcagatgttagttgatgcgatcgccagagtcggggcaagacatgacggaaagccactcctttcgtccgaagccgtcgcccacgtgttcgcgcgagccaaacgacatcggactcaggagtggggggacaactgttgggatataccaactgacccttatacgccgacttaccctcggaccggtccgaccgatgcccgacggacgacttcgacggatgaccctgacggatgactccgaccgacgatcgatggatgactccgacggatgaccctgacggacgactccgatcgatgactgacggacgactccatcggacgaccccaacggacgactccgacagatgaccccgactgacgacctcgatggatgaccgacggacgactccgatcgacgaccgatggatgactccgacggacgaccccgacagacgactccgacggacgaccccgacagacgactccgaccgacgaccgacggacaactccaacggacaaccccgatggatgactccgacggacgaccggtggacgactccgatcgacgaccgacggacgactccaacagatgatcccgacggacgactctgacgaacgactctgatcgacgaccgacggacgaccctaatagatgactccgatcgatgaccgacggacgactccaacggacgaccccaacagacgacttcgacggacgatcccgatggacgacttcgatcgatgaccgacggatgaccccgacggacgactccaaccgacgaacgacggatgactccgacggacgaccccgacagacgaccccgacggacgactccgacggacaatcccgacggtcggcaccgaataccgacatatagtcggtcagtccgcccaaacaccgtacaactgctatgggcagttgtcctgtcaaggacatgcggcatggccgctctggggcattgtcctgccaaagatatagattaatcccagcgacttgacagcccacggtaatttgacagcccacggcgacttaacagcccccgacgatttgacaactctccagtcgtctgcaccattaatggcgggaccataccgcgttctattataaaatgggtgtcacgctcctgacccgagattgtgaatcgagggtcatggcaaccgccgcatactcatagaaaactctttccataagcatgcaaggcatcttatcatactatcctaaaacaacagtgaaataattagtcaataatttaaatctaaaatataatgacctaaattttnnnnnnnnnnnnnnnnnnnnttaaaaaggctcaaaatatgtagctgttactagcactccataaacataatttcttcctaatcgctagaggttcttctcatttgatggcctatccaatggatcatggatggcaccatggaaacaagtactgcgatttaaaacgtgcactatggcatggtccagcgtggtacattgtgttttgttaaaaaaaaaattgcatgtcatcagaaagcgctttaaaaaatttcagaacctgtgctctgagattcctgcttaaaaaggaaaaaatattaaatccttttactattaaatgccaaccatatgtctaggttccaagattcccacaaaaacgtaaaaataaagtccgctgtcttcctgccttcttttaggaattgcatgatggatccatcgactgataagatttttctgcacacatcgccaaggttttcttagatctgcttcccatcaaatgcaacttggaacgtggcagcaagaggatggttgcacttcaatcattaaaagtaaagccctcattctttttctgtgaatacgatttttttttgataaaaaaaagaaaaaaagcagtggagaactaccactcaacttttattagaacaaagggttgcaagaatgtataatgagaaagagaaaactaaagaacagtaacaaagagattcatcaaagagatagggtatcttactcttggttacagagttagccacaacccaacattggtccagttaaagcacctattataaaaaaactcgtaccatagaaagccacttcaatgatcactttcagcacatgccttgagcctgtagaggttatctgcatatcgcctagttatcaattggaagaagaacacatcagagaagagagtttagtgcaaaaaagagcatgaatatcggcctctttcctcttgcaaatgagctcccaactaacaaatgtatccagaatttttgcaaaacagaatagacagagctatttttctgaagaaatatccgnnnnnnnnnnnnnnnnnnnnnnnnnnnnnnnnnnnnnagtgttcctctctttccagatttctcaacacaaggcagccatcaattgatccatcacctttcttcctaaggctggaaatttggctcttctacatttagtgcagaggtaatgcagattggacagccatccatatatctttagctgaatttttagaacagtccaaatactacgtgcaaatggatatttgatccaaagatgagagatggattcaagtaatgccccgcaaagaatacaaccagagctaattgaccaaccttttctttggagaacctcaccagtgtgtagtttcttgcgaagagccaaccacaaaaacaccatcaccttctctgaaatagccactttatttatttatttttttacttttttctttttcagttcctcgctgttgtccatatgactgcaatggcccctgttgcagtttactagattaaagtcatcgatgctgttatgattattatgtaaccatgtctttataaataaataaaattccctacttgccaaggtattggcaatgcatgtgcatgagtaagttatttgtgataatggcgtgcgtttggaatgttgtttagatatgtccagctaagaactggggttccattgatgttttctggttctctgattctgaaacttgtttgctatggagtgctgagagacaccaatactggtattgagattgcatttcagaggcagggaaaaagatatgggtggtgttattttcagctagaaatctttgttctcttcagaattacgtcggaattgaattcatggaggagtataaggtgccctatgaagggggaaacagcgccaagggtattccctgaacgccatcagtctatgactgctggttcttgccatggggcatcgaggtattggactctagttactctagcatggagtcaaggcacagggattatcattttccacagcagattgttggaataaaaagctgtctgaattcccaggtggaatgctatgtgaatttgatatgtgatcaatgggaagtcatggtgggtacattcatgaaactcttttgtgaatttgttagaataaacttgatgtaaatttcaattttttgagagttaccttggaaaatctgtgaaaattggaactctcaagatctgtgaggttggatcatgtgtttctcactgctaaaagagacttcagatcgtatgtgcgatcactgatggaaagtacgtaaataaatccatcattttaagtgctttgattgttagaataagatgaaaagaccaaagagagtatttgataattttcacatgtctctctcagaagtctttttacattaattccctctattatttaaatttagatgatcatgatctagcaaacccatcatggatggcccaatcagattcaaaatccaaaataccatatattcacatcatcattcacattatttgatgaagcaattaataaaaaataactgtaatcataattaacaaaagcactataattaacatctgatacgataaaatcatctaataaatatccagtgctataataagttgtccctaaaaatacattaagacaagtaccatgaaaattcaaactatatcctaataattatacaaattaagtttcgtcgaatatttgatgcatatatgacatcatatagaagcagagtatgaccaccatttaatagtaacttataggtgccaatattttttgctccaactctggaattatctcttatatatatccatcttgtgtcacgactaattcaacgatactccacaaaagctcttctatctctagctatatgatctgtcgctcttgagtcgacaatctacacaacggaattcaataagcaaaaaacaactagaaacataagaataatataatataatggagcaagagcatacctttttttggctagtgcactcacgagtgaagtaatccagtttgctatatttgtagcagcatatctcaatcttgtccttctttttactaccatgcttgtctttcttgtgtcagttattcttattaaatttggatacttgtcctttctctttacccattttgagaaatttccatcttttacacttgaagccaggaatcttgtgtgagctagattcaactacataggctaacctgaaagatttagctgccttaaggcactcatcttctacctccaaatgacatactatatcatcaaaagtttttacattatcattgtgtatcatagtatgttggaacaatatttaaaaccagatgtgatttaagaaaagtaacgagagttttgattgcaaaggaatattgtaaaaaacttatagaaatttaaaaataaaaaataattaaattcagaatcgtgttggatattgttctaatatatattaccatctctcgtgcaagaatatttgaaaaaatgaacctaagatacgactaggatcttccgcctgcgagtacaatcatggaggaggttgactgatgaagaaaaaaaaattataattgaagagaaaaaatcattaaagaaagaagattagaatgctcttagatatcctataagtttagagtaagattagaaaaaatcaccaacccggtcttcaatcgatctattttaagcatgtttatgtctgacataaatagattcatgctgtaaatggatagactcaaacgtcctcactatttattaaataggttaggttcaagttccattgtctaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgacaggacagcgccccgggctcctggcaggacaacgccccctggcggttgcacggcctgtccttgacaggactgcagcccatgccgttcgttcggcatttttgagaggggccgaccgactatatatcgggatgtggctatcgggcggtgactcaagagcacagtcggcgtctagaagggcctatagaagtcgggcgtcggttgtccaacccgacaaggagtcggcgatgtcccacccgacagggggtcggcgatacagggtcggcttcgggtgatcggaggcaatgttgggcagtttggccgacacgctcgggcagggcatcatcggtagtcactattggtgtcgcccattgccagacgggcaaagtcggtcggtccatctcaaggatgggtcagcatcgggacccatcagtgaatcggcgtcagggtcagtcggtatatcccagcagttgcccccccactcctgagcctgatgtcacgtcagcccatgtttctacgtaggtggggcatcgggcgaaaggagtggatctttattgcatcatgccctaatcctgttgatctcaccaatggatgatccggataaatcggcgtcagacgactcgatgtccgatgatccggtgtcagatgatccagtgtcagacgatccgatgtcagacatcctctggaaatgcagaccaccgtctgaagctcctttaggagcacggaccgccgtcaggcatcccatcgggaacgcggaccgccgtcagcaaattaattctgaggcgcggttcttccgccatgtgtcgggaggtcgttgggctggagtcgttcgtgcggatgaaggcgacgtggctcgatctgggacgggtgcgtcgaatcatcgggtcggaggagggcccggatgctgccatgtgtcaatcatccgagaggtcctcgtcggtgcgccctcatcccgaccgtcgaggggccctatatatatggggtcgctcgtatccaaaaccttatttttcgtggttctgctgcagagactctgcccgaggggtcccccttgtcccaggtagttgcttctgctcccattccttgagaagtcccttcgagacttttgtctcctttcgccttctccttgcttcttttggaattcactccccttcttcttctccgtcttttccttcttcctagttctggcatcatggccaggacttctcctcggggagctccgtcggggaatctgactgatgatctttgatcgaccccggaggtggaggcctcttcattttcgagaccgaatgtcgatcggcttcgaaatcagtactatatcccggagcagttccgactcttcgcccctggggccgggggatgggtcaacaacccgcccgcgggctaggtggctttgtatgtcgaggaccttcgggccgatcttcgtctcttgatttcggagtttgtccggaaccttctggattactacggactttgtccggcacaactggcactgaactcagttcggttaataatcagttttgctttgttgtgtcagcttttgccgaccaaccctcggatctctctcttcagggtgttcttcatcctccgaccccatcctaaagcccgagggtggtggctcttcaatctccggaagggtctctcttttatcacggatcttccatcatccattcatgggtggaagaatcagttcttctttgttttttcttcctctccttggaggttcccttcccactggggcgagcctctgactgggccgaacgagaacagccgagtggaggcggatgaccgggaggatttttaccgacttaaggacatgtcggtaccgaagcagagggagcttgttaccgaacaagccctctatgatgccggtctgagcctggtcccccgtctaggtactgcccggtctatcgattgtcttttcacttctcgtttgtccccgaacacgtactgattctcttattgaaattgtaggtatgtcgccgaggatgagaccgacagacgtcgagatcagacaatatgcagcgaggaagaggctggcatttggggccgggccctgacacccgtcgaaaaggtctcagatgtagcccccgaccgccactgcatcggcggtcgatcagtcggagccgatcatcgcgctctcgatgtcggcagtgccatcaggggagcagctggtggagggaatggccgaaggagcgtcggcggcggcgtcgatggaggaggcccaaggtgatgctcgggagcccgagcatccttcgttggctcccgctgctgcctcggggggagctcaatcgagtttgagcctcccctccttccccgatctatgggcctgagcggtcggtcgggggaaggccccgatggtccacgcgggcgactcaaggtcgggggaccgcgtctggtcgtcgggcgcccggatccccgagggagcgtcagccctggccgaccatgacttggccaggagattatgccaggggaccctccttccagccgacctggaggtcctgaagactcgacgggtgaccgagatgctgtcttccttttacccgaccatgatcggggtaagttctaccttgtcttctttcttcattgttgcctttactattctatctttctaacggtcggcttctacttgcagttgatttacaccatgtccgagttagaagccagatatcgaaagttcggagacatccgggtggcctggaaggacaaggcaatgaccgtcgaagccgagaaggcagtgctggtcgaacagctgaagctgtcgaccgatcgggaggcgagactggaggatgagatctctcgccttaccgacgctttggctgcctcgagggctgaactcaagtcggtccgcgaggaagctaagcgcaagggtcgaaccgctcaccgattgcggtgcgagcgggatggcgtcgtcgccgaactcgaggctgagtgcgagcagctccgggttagcctggagaacctcgccaaggccgaggaggacttgtcaatcgctcaagccaacgctgacatagcgaaggtggaggcggaggcgaaatcgacgacggagtcgttaggtcgggcggtggaggacttctgcggcttcgacaaatatcgagaggagctcctggaaagcgattttgcatcgtaccgggtggggtacgaagacgctcaggatgcagtcaaggctttgtacccagagctcgacctcagcggcattattcccccaggatcggtggagcaagccacagaagaggtggccgacccatcagtcgggggatcatacagcgatggaggaagtcgtcccggagcaggttgccgaaggggagacggccccgacctccgatccagcaccgacccaagcggacatgccggctgcccccgagcttctcccggttgaagaggtcgactccgaagagtaatcggagttgtttttgtcttgctttatatacttgtaatcgggcttcggcccaattttgtaaactcgatatatttataagtgaaatcgagaatttttaaactttcttccctttgcatattaagatgcattctgagtcatgtgcttcaccgaagcgcttcccaagcatgaagtcgtagacccatcgtaccttattaggtcgctcgctaatatcccaggtcgttagccgagatagtcggtagcatgcaccatggaaaaggcgaggcgagtttcgattacagaccgatcgttccgatgttcgtaggatgcaaccatcgaaggcctgagtcaaacttccatcgtctggtcgtaaatcgggcgtgttcgtcgagtcgaaggtcaaagccgtctgtgcatcgcccggacgtgagtcgggcatgttcgtcgagtcgaaagtcgaagccgactgtgcgtcgcccggacatgaatcgggcgtgttcgtcgagtcgagggtcgaccgacctccgaacatagcccgatgatccaatcattccgtagggtcgaatgtcgtccagtgcgttcagtcggatggcgtccgacgcgttcagtcgggaaaatgatggcaagtcgagttcccattacccagactttgatcgggtacatacgtcatggtgcgtgataaacggtggcaagccgaatatccttcgaccgatcgtgacctagtcggtaggccacgaatgcgacattggtcgcattggcatttggcttttcttggccggggccaagtcggcaagttagccgattgttttgctcgagagtttgactgtagaaggagtgtgactcccgtcgttgtggatatatcggtcatcgtaagtgtctgatgtgtcgttggcgatcaggtcgttgattcccaatggaacgttgggcccaagtcggggcgtcggggctcgtactcctgacgagcgccgacccacagtcgaagagtcaagatttcagactccaaagttttgaaactgaatttatattctggacgaggggatacagagttcactggtagtacaacctcagattgtcggcattccatgtccgagggatggccgttccttctagggtctctagtcgataggcttccggccggtaggtgtcggctatcttgtagggtccttcccagtttggggacaacttcccctggtctagaggcttcgaaacttctgcttttcttaagatcaggtctccggacctgaaaagcttcggtttgaccttggcattgtagtaccgggccaccttttatcggtaggaggccatacggatctgtgcctcgcatcagagttcgggcaagaggtctaagtcggctctccgacactcggagttgtccggctcactatactgctcgactctggtcgacggtagcccgatctccagcgggatcattgcttccgtcccataggccaagttgaaggaagattccttggttgggacacggggcatcgttcggtatgcccataggacagagggcagttgctcaacccagaggcccctggattcattcagcctggtcttcagtccgtgtagaatggttcggttggtcacttccacctcaccgttcgactgtggatgcccgactgagatcagcctgtgcgctatatgaaatctcgcacagaagtctctgaagtcctggttgtcgaattgtcgtccattgtcggtgataatgatgttcggcaatccgaacctgaagatgatggacttctggatgaagtcttccatcttttgctcggtgatttgcgccagaggttcggcttccacccacttagtgaagtagtcgatcgcgacgactatgaactttcgttggccagacgtcggagggaaaggtacgagtatgtcgattctccactggacgaagggccatggggcgacgatgggagtcagctggctggcgggtcagtgttgtatgttggcatacctttggcatggttcgcacctccgaaccaactcagccgcatccttcttcatggtgggccagtagtaatcctgtcgcaggactttgtaggccaaggatttgcctcccaagtaattaccgtagatcccttcatgcacttctctgagtgcatagtccgcatcggctggccccagaaacctcagcaagagaagagagaacgaccttttgtagagtcaaccgtccaccatcacatattgggaagctgcccaccggagtcgtttggcttccgttgggtcttcggggctagttccgttggtcaggtactgaacgatcggatccatccagcacggctcgatcgccagttgtagcacctcctcagtcttgtcgatgcttggttgctcgagactttctacgagcgtccggcccaaagtgccgtagtcggacgtcgcgagcctggagagtgcgtcggcccgagcatttttcgccctgcgaatgtgggagatctcgaagtacttgaagatcgctatgagatctcttactttctggtgatatttggccatggtcagatcccacgcttcgaattcgtctttgacctgcccaacgatcagttgagagtcggagaagaccttgaggctgtcgaccccgagctctcgtgccaaccctaagcccacgatgagtgcctcatattcggcttgattattgaaggccttaaagtcgaatcagagggcgtgctcggcaaccactccctccgagttggtgagcaggaacccggccccgcttcctcgagcattggaagctccgtcgatgtgcaacacccaggttgaatcggggtcatattcgaaggtcccaacctcttcgaggctccccttttccgacgctcggttggtcgtcgggcactccgtgacaaagtcggctagaacctgagctttcaaagcaggtcacggtcggtactgaatgtcgaactcgctcagtctcacagcccactttgctaaccgtcctgatgtgtcagggcggtgcaggatcactctcaggggttggtcggtgagaaccacgatagcgtgtgcctagaagtatggatggagccgctgtgctgaaataaccagggcaaatatcattttctctgccttcgagtatcgagtttcagcttcgtggagcactttgctgatgtaatatattggttggtgaactcggttctcgttctctcagacgagcaccgagctaactgcctctggagaggtgccaagtaaagatacagcattttcctgacctccggcctcacaagcaggggcggagaagccaaatatttcttcagttcctcgaaggtccatcggcactcgttcggccaagagaagtgctttgcttgtctcagggttttgaagaacgggaggcatctctcgatcgatcgagaaatgaaccgattgagtgcgatgatccttccgttgagttgctgcatctcctttttggtgtccggatgccgcatgtctacgattgctttgatcttctcggggttggcttcgatttctcgttgcgaaacgaggaacccgaggaacttctccgaggtcactccgaaggcgcacttagttgggttctgcttcatccgatgtcatcgtagagtgcggaaggtttcttcgagatcttgtacgtgatctgaagtttgcgcactcttcaccagcatgtcgtccacgtacacctccatgttgcgcccgctttgatctttgaagaccttattgacaagtcgctggtaggtagcctcgacgttcttcagaccgaagggcattactcgatagcagtaaaggcccttggcggtcacgaaagccgtatgcttttcatcctccgatgccatccagatctgattgtattcggcgaaggcgtccatgaagctgagcagtcggtagccggacatcgcatccaccagctggtcgatcttcgaaagtgggaagctgtcctttgggcaggcccgatttaagtcggtgtagtcgatgcagatcctccacttcccattggctttcttcaccatgacgacattggcgagccaatcgggatacgtggtctctctgatgaagcccacctcgagtagcttgtccacttcttcgtcgatggccttctgcctttcgggagcaaaagatcgcttcttctgcctcaccggccacatgtcagggctgatattgagtcggtgggtcattatttttggaggaatgtcggacatatccactgccgaccaagcgtatacgtcggcattggctttcaacagctctatgagctgccgtcgccctgggtcggataattgcgatccgaccctgaccatccatttgggattttctgttatagggatggaaactagctgctcggccggttcactccgttcctgctcttctcgttgatccagcttgtcgatccgcaaggaatccttccgcacgtcactctgagtcgagatttggaagcatcgtcgagcgagctgttgatccccgcgcatctctccaactctatttttagtcgggaaccggaccaacaaatgatacgtcgagattatcgctctgaaggcatttagtccaggtcttccaagaatggcattgtaagccgaagacacttggacgaccgtgaaagttaagtgggcggtgctttgtcgtggttcggttccgaccgtcatggaaagagtagtttctccttccaccgtgacggctttcccgacgaaacccaccaggggcgtggagactctcttgagccgatcagtagatagtcgcattcgggagacagtcgagtagaacaaaatattggtcgaacttccattatcgatgagaattctttttacatcataattagctattgttgtcgagacaacaacagcgtcatcatgaggagtttggattctctgagtatcttcatccgtaaaggtaattacattatcctggcgcagcttcttcgtcgactcccctatagcagtcatccctcgatccgctcgtttggagatcatgttgatgaccccggccgttggttggttgttcgccgcttcctcagtcggttggggtcatcggtcggggatgggtcgagtcagcgggctccgtcagaatttatcgaggtaccctcatcgtatgagggcctcaatctcatctttgagctggatgcactgctccgtgttgtggttgtggccccgatagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacaaaacaccatcaccttctctaaaatagccactttttagataattttgtagtaagggcaaacaagtcctccattgttaagaaatttatagtaggattcaacagtgtaaatactagattttgagagtttccatgaaggtgcatccgcaactcttgatggtttgatgatggccaaactagcttgaaacaactccaaccgtctactttggagtaaggaaagagatccattgagcttgatacgcgaagccaaagacctccaagactattgtgagacaaccgagtaattgggcttacaagtaatactacagagattctcgaacaaagaggagaatagtaccgaagcacaccacttatcttcccaaaaatgaatattatatccattaccaaggttaaaggaaaggcaatcccagaaagcacaaagttgcttgcaaatgtctctccaagtatgagacatctttttcatgcttcgcttaactcccatccccatcttcctcttttgataatatgcatatttgatttgcaaccaccagggagatttttaacccagagtaaattttcatgcccattttgctaaaagagcaaggttgaattgctctaagtttttgatatcccaaccatccttctcctttgaacgacaaatgttgtcccaattaacaagaaaatggaagccactaacactatcatgccccttctataaaaaagcatgccgccacctgtcaatgcgatgaagcaaccattttgacagtttaaatataaacatgtagtaagaggagagagcaaacataacggagttgataagagccagccttccacttcaagatagaaacttttctttccatgaggctaatctagggttgatcttttcatgaaaaggaagccaacactgtctagaaattctcttgtcacataaagagaggcccaaatagataatcgataattgtcttttcttgcagttcatcatagttacaaaagtaaaggcttcaacatcatccatacacatacaaacaatcaagcttttataaaaattaatttgtaaacctaaagcactctcaaaacccaagaagatagctttcacaatcatcaagctttgtttatctccagtacataacaataaagtgtcatcgacaaaagaaagacttctgatgccctgaaaagcaacattctcactgatttctttaaccaagccaagggagccagcatgcttgagtaatctggatagtacatcagcagccaaaataaagagggtaggggataatgggtcactttgtcacaaatcctgacgatatttgattcaattatttggtctaccattaactaaaagagccacagaggaagtgctcaagagatcctgaatccaacaaatccatttggaaggaaaacccctcatctctgggagatcaagtaaaaaatctcaattaagcttatcaaaaatctttttaaaatcaaatttgcactcttttaacactgcctcttttgcaataggcaatttttttgcgaatatgttaaccatgattgtgggctttctaagctctactatgctcccaacaaaggcacccaaaggcctgcaaatgggttgggtcggatcgagtcccgagtgatcctgatctgatccaatttcttgatcgggtcttgatattggatccatcccatcctgataaaaaatcaggttgggtcggatcggatccatagccgaatttattgacccattagacattcagatcagatcggatccatatataacccggtctcaatccatgaaatgggggatcggatcggatcggatcacgagtttaatttatttgaaacctaccatcagtgaatactaatgttggatgacaactaagaaagatctcttttttttttttttctccaatcctccaactgtaacttctaataattaattgtattggatagtaaaggaaaacaagcggtttttgagaagagtcaagatttcagaaatccacacaaaagaagaaatttaaaaaataaataaattttatatagtgatataattgttccaatctaaaacatcatataagaggaatacttgtacatgattaaaaatgagattatatatactgtggatgatgcaatatctgcgcacattagagcatgctttgaaattttttaaagtcaacaaaatgaattgaaattcaagaagttttcttacttttatacctcatagcacagtaaatataaactagaaggtttaaaaaattgagctcagcaagaagccagaagaagtagtcgaaatatcttttatttaaattatcaggaatccatccaatattttttcttcgggttgttatagatgttacaatagtcagaataaaagaactgaaggatttgaaaaatttttagttttgaagattttttgtttgagaattggatggaaaagatcaaaggatttgaaaaattttgattcaagtccaaatctctatttgggtgagtcactctaactaggttcgagtcctatgtttagatccggatcgagtcggatcacgtatcttaagatacaaattaatccaaaaatcttcacgaatcagatcgggtcgggtcggatctcaatttaaaaaattcagattcgattcagaaaagaaaatagatctaatttttgaatccaatctaattttatgattcttttaaatgagtttagatcaaatctaaatgaattgaattggatcaaattatggatcaatccgaaccatttgcagccttgggcgcccatcaaccgagtggtcctttggtttgctcaccggaacaagaaaagcacaaaacaaactacaatttctctggctcatacacacggccggccctggggcgggtcaaagcaggcgaccgctccaggctcctattttttttttttgtctggataaaccaaacgccttcttcctctcccgagtcccagcaccccaacgacttttttggataaaccaaacgtcttctccctttcataacctgtagctcctctcccccgcctcctcctccgtctccaatcttttcatcctattctgctgtccatcgatgattctttcttattttggacgtcaaaaatcagatcaaaatccgtcaaaaaatcaagtaaatctcttcaatcctcctctttcaatttgctatgaataattaatatttaaaatatattaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcctccacctccgctcggcccactcccccctccgcctcctccatcgaggcattagtgggactgggagttgaaagccgtgtaaatttttttttaatgactgttgcagtgctgtatcacagtgaagcaatgggctgctgcttatgacccgtgagtccatgaccatgagtcctactctgtgggtcatgaaaaaaaaattttttaacagaagtgggagaaattattgatgattcaatactgttattttatcttctacttataaattataaattatagctcaatttaattttttttatagattatcaaaatggcctctattaaggggagcatgccatccatggatgatacaagtaatacttcatcttctggagttaaagataaaagtaatcctgcatgaaatcattgtagagaagctcaagaacttagtggtgataccaaaaggatgaagttggtatattgatattgtgaaaaggcatttgctggtggtgggatcaatcacctcaaacaacatcttacaagagtaaaaggagaagtagaattatgctacaaggtgccggcagatattcaccattaaatgatataaaatattcaagctattggtgagaagaagaaaaaagcaaagataatggataaagattacaatctctttggtgcaaggcataaggaacatgagaaacaagtatattataggcaattgcgtgaagatgatgacatacaagaaattcttcactcattaaacaagtctacagataatgcaaaaagtaaaaatatagaaggtgaaaaagaaaaataattaggaacatttgaaaattattcatgctaagaacaacttctggtgttcaaccaactattaaaagcttattgcaaaacaaagaagcagttgaaagttgtgatcttgcaatggcaaaatggaagatagatgcatgtgtgccatttaatgctgtcaactctaagtattatcagtgcatgatagatgccatagataatatggggcctgattacaaagcttcaaattttcattctgttcatgggttatttattaaccaggaatgttgatgaggtaaaaagttatattgaaagctttcgtgccacatggaagaaaacaggatgtacaatcatggctgatggatggacagatcagtgtaggagaactttgatttattttttagtttattatcctagagggatcatatttttgaagagcatggatgcttcagatacttcaaagacggctaatatgttacacaagttattcaaagaaattatcatatccgttggttctgaaaatatggttcatatagtgactgataatgctataaattatattgctgccggtaagaagttggagcaagatttttctactcttttttggtcactttgtgctactcattgtcttaatctcgttatgcaagacatcgataagttagtttcagttaagaacacagtagcccatgctgcagatatcataaaatatgttataatcattgttatcctttgtatttgatgagaaaatttactaatagaaaggagattatttgtccggcacccatatattttgctaccaatttattgctttacaaagcattttggaccacaaaagatatattaagagcaattgtgacttctagagagtggacaacttcaacttatgctaagaatagtaaagaaaaaaagctcgctgatgatgtgcttaattttttttttttggaatgaatgtgcaaccattgttaaactaatagagcctttaaatcgagttttaaggattgttgatagtgatgatagactttcaatggactacttgtatcatgctatgcatcaaactagagatgaaataatcaaaagatttagaaggagaaagactgtagttgaatcttatttgaggataattgattctcagtgggatttgcagttatatcaaaatcttcatgcagctagattttggttgaatccttatttccaatatgatttagaatttatgaataaacatcctcgtagtatttctagactcttagatattatagagaggtattcatttagtaatccgaccttgcagggtaacttaactaatgagatgagattatttagaaatgcagagaatgactttggacgctcatcagctatacatgatcgaagtcgctagcctccagataagcttgttccttagttatgtctttatgctttcattgatataaagttttttcaattgcattctattttaacaaatataatattttatatctggatgaatggtgggtcatatatgaaagttgtgcacctaatttgcaaaagttagctattcatgttttaagccaaacttgtagtgcgttcggatgcgagagaaattggagcatctttgaacatattcattctaaaaagaaaaataggttaaagtaccaaaaacttaatgatctagtatttgtgcactacaatttgagactacaataaagataattttattatgaatgatatccaattttttttatttattttttattatttaattttcaaactaacaaatactaaatataggttttatttcaaggtcgcaactatgatcctattgactttgaattgtttggtgataatgatgcatgggtattagtcgataagccacagagttaactagtggggaattagcatcttttaatcatgaattggcatcatgttctatttaagaaaatgataataataatgagcgaattattttattatgtaatttgtaaataaaatatcattacaatttcatgagatatgatttttttttaactttttgttaaatttgtgactttgtagatatattgaacttagaagatttggattgtgatgatggtgaaaatgatggaaatgatgttaataggagaaaagataaaggagatgaaaatattgcaagtcaagaagatatttttacgaatattgacataaatttcagtccattagcttgaatttctatgctgtgtacttgtttatcacttttaacttttttttaaaaaaagatattgaagtgaaatatcgtatattattgtgtacttatttgttaaaatttttcatcttgctagcagatgtggatggttatattttaaagttggattatatgtttgtgcttgtatcaaattttggtatttctagatataaggttagcagttggttgagttcatatatctttaccagcttcgtttgtgtgattgaataatgcatgcttgctaactgctaagatttataaattcatagcttgttatctgatgaagctttttatgatttatgttattgtggatataatgcatgaggtaccatagatgtgcggtgggaatagtcaaataagtttaaactagtagttaagtagttattataaatttataactttatatcattaaatttttatatttatgaatattttaatctagttatttatatttatgggattatagttatgttttatttatattttgatatgaaatatatataatcaaaattattattaaattttgaatataaataaattattaaattttatattttatgtattgatccatcgatctagttgtagatctggtggttgaatcattaattcattgatctgataggttgttcgggtcaaagtcggtccgaatataataactttggatcaaatgttataaggatcaccgtagaacgtatgtttttaatgcgtaccacgtgtaggcctctaaactggggccttttagcaatcgcacgagggcgcgctgattgacagggatgggataggacctacagctttatttgggggacccaggatcctccgaactctgcttggggacagaagttgatggcttcgggatagcatcacggcagccaattcgtttaacctggtaccccaaaatatgaaattatctgataatataaatattaaaacaaagtggaaagatgatgctgcatgtcattcacgagaatacaatgctggcgtacaagtgaggaaagatttcagagctgtaaaattcgagttacggtgaagatacttacagctacagtgggaaattaaggagccggtcgctggggtgtaaaatagaacagtctgtgtggtgcctgctagatatgctatccactgcacaaagttgttcaaaaccaagggagaggatgaaaggagctgggaacttcaggagagcacaaggtaacagatgctgggaatcaaaattgcaagtctcttctcttttgttcactgcacatatggtagtatatattctgcattttatctgcagttcggtcgaatttttcttccttactcatcaacagatgcttaaaccatcatctgtttgagatgttattgtttagattcagatgctgagcaaaagttttagtatggctattctgatgtttcatttactaaagcatgcaaatcaattggattggatggtctggaaacatgccatgaaaacttcaactggtgtcttctctttctttaatttcttgctgacaggaagaataatggaaaataaggttcataaacatgtggtgaactcttggttaatttatgacaaaacaggagaaatgcaggagctggactctgcaaaccatgggggaaagaaacagtggccaagcatgacacaagaggaagaggacctgataagcaggctccaccacctgctaggggataataggtaactggtacccatctgtcattttatttttgatgtcttaacccttaaatctttcaaggaaataaattaaaaagagaaaaataatgaactcgtttcttgcataaattaatcacaggtccctttttttttttcttgtgaagtatgtatccaacacaaacaaaaggcgatcatagatgaatcatatagatatatgagatcaggagatttcctttttcccttccgctcaacaagcgtaaaaattactagcttttgcagggaacgacaatattaatatttaagaggcatgattttttattgaataaagggaagctaaaaaggagcccccggacttctatgaatatatggataaaagcatttagaacttgggagagggaacaaaatgagttagaaagaaataccaatgaataatatgaatccgaatccatgaaccctgtaaagcaccaaaaaaaaaaaaggaatccaaatgaaaaaaatcagacaataatatgaagagagttagaaatattctttcgtaggctgcaggtagcttcttttgattgcatagaataggccacttattgaaatcatcaggccaacataagcaatagaagtgatggaggattgcttgttaaaaaaaaaatccgtgcaatatttctatgcttccaaacagctagtctagatcatcaccacgaaaaacatgagaataataggctgaaatttctaaaaggaggtttaagatgcatgatttgataatatcaccttcaccagatgggcgaatatgtttgccaattacatctacattgcatactaaaatagattttagcgaacacttaacctggaaaagtggtgcgcatggaccttttatcatttcttaattgttcttcaaatatttatttattgttttttccttttaatgtcaggtgggaactgattgctaaaagactgccctgcagaacagcagaagaagtggagagctactggaaaattaaggggagaggagaatttgagaacaacaagatctataagcctgtctgtacgagactgagtccatcctttaagttcacaatggatgaacccttggaagatacgaaaccatcacaaagtggatcttgaaatacaaggttccttcactcctttatttggacaaataaatacatcgcacgtcgtgaacttcttggtcttagaatctaaaaaaactttgcaccaccaaccgtaccctgtataagttatcagttgatccatcttaatttattgccgttagctatgtaacgtttaacacttgtgcttctttagatgctgaactgtcgagtatgttccattttttgaagtctactttattccgatccataagatcagcttcatacttctagtaaatcattgaaagtagttcttgttccaacaaatatgaatcagatagcaaaaaaacatgatgcatgttagtcaagcatccaaatgactttagttatgaaaactttcatcaaaatgatcatatttatttatctcaatccctaacactgtcacgcttcgaatctaatattcggatcggacatgtgatggccgcacacttcttagagcaaatccctaaagaatgtgcaaggcctgcctttacatttaaaaatatcacatcaaattataccagacaatggtattaaaagtaaacctctaatctatataatatatataataatagtaaagtgatacatgggtattaggggcggtattgcatgttgacacgtaaggttataggataatcttccgcaatgccatgtgtcaaattttattttttattttttatattttttaaataaaaataaaaatatattatgataaaaaataaaaaatattttaaattattataactcaattttattctaaaaagagaggaaaaaaaaagcaaataaagtcatggtcattaaaagccaaaactctttaccctctttctaccccgctactaacgctgcctctgaagcttgtattgtctatctatcttcttcataaaattgaatcttggtgatgccaaccatggtggaaaggtggaggaaactcttcagaagtaaatgaaataatcatttgcatctgactccatggtgctcgagtctccacccaaaagatgccaatgatattttcaagaagatgaagaagatggggcttatgcctaatgcagttgccatgcttaatggacactgcaaagatggattggttcgaaaagtaatgaagctatttgcattaatacaaaagaaggaaacaatctctaaggttgtagttcatacgatgattgtggaaggcttctgcaaggcagcaaaatttgatgatgcaaagaggattttcaaaaaagatgcagaaaaatgaaatatgtcggatgcttttagctatgcagttctgattcagggcttgtgcaaagagaagaaattggaggattctgttgagtactatatggagatgttggatgctggacatttattaaatgcagtaaccttcactggtttgggaggctatctttggaaaaaagaactctcagagattcttttgatctcatcatagattaattggtgagagcaacttttaatataaaatgttattattattatcaattaaatccccacaacgtgcaggttgagtgctagttttattaattcaaataaaatatatatcaccaataactcatcataatcaagaccaatatttatttaaaaataaattaagcaaatatcctctaagatcttatgctcctcattgctcaatccaaaattctatagaatcctctggatctgaaaaaatatagaaaagagagggtgagctttacagactctataagttatcaatatctctgagagttcaagtataaataaaaattctttttcaaacatacaataatagatgcaaatactaatatatttaaaaataaaactatgccatgtgtaacagcaagatctaaaaaaaaatctctcccaatttttgttgtctatagccacaatcagtcccgtgataaggtccaggagaaactaacccctaaaacagaacattcgatccatcgatgtatatcggtgaccagccccactatctaggctgaggagagaattagctctaattcatacggtcacgatttaccctatgacaaggcaaaaagattagttctaaagtaagaaacatgcgatgcatcagtgcgtaccagtgatcagtcccgactggctaggcccaagagaactaactcagctagcgattagtcccaactggctagattcaagagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatagatcaattagattcaaaaatcatagcctttgattcatggtctgatccttagatctgcacttctcacgatatctattttgacttggccaatatggaaaagagagagatactcagtctagatcatgatttggatagaattgtgggacgaatctaaatatctcagatttgtctttttggttctttttcttcttctttgtttttttcctttctctctctatctctcttttttctcttttccctcaaatctctcattctctctctactcttctctttccttttttttgtccttccctctctctctcgttctctctctctctttgttctttctttctctcttcccaggccgaagagatggcattcctcaaagaaaccagggggaagatggaggggtggggtcaatgatggtggtgcggcagggtgctagcaatggtggtggcttgatcagcattaccggtggtggaaaatcggcgataataatattgaaaacaaaggaagtagcaaaaattgaggagaaagggggttttcggatgacgacaacctgcttgtgaagtctaatggctgtcgaaggtgaggaagaaagaagaggaagagggattttggtgggggatcaatcaaaagcagggtttaaatagagaaggagaaaagaactgataagctcaatttctcctcgaataaagctgaatctcgccgtcgtatcccatccaaacactctttgactaatttcacttaatggtgcacggcactaattcggccaccctcatggcttaatctgccccctaaagtcagggattggcaggggatgtggttccgctttttttttttctgagaagtcctcatgaaccgggtccactaggatcggttcttacattctctttccttaaaaaaaaaaaaattatcctcaaaatttgagaaatctaagtcttccaaagttaaagatgctcaacctaaacttacatacaccaatttatcctggcttggcatttttgtcaaactgaatatatgatcatattataagatgcccgcaagcaaatccaacatcttaggtcaaccacattaatgctcaagcacatatctacacctaagcatggactctttccaagaataattcacaatttggtacctccgcatcgattttgaaatttgcccccatgatatacaatcaaatatctcatctctttttgatcaaaatcagtgtgattactaaatcagaagctttcaattgcatttaagattaagatatagaccaataaaatcaacactaattcagtaatcgagactttgagattaaaataaatgcatgttcatttaagattgagttgggatcaattgggtgcaaaaagtcttacagtaagatcgattataaaaatcaattgtgcttggaatagagcttgaaataaatttcaatacaaatactatgatgatgttttgatctcgcaaaaagttaatgacccaccttgactaaaattaaataatcagataactgtgaaggtgattataattatgttgtaatggctataggcaataacgatccatcaccattgagaaaataatctcaaaattgaataataaaaattaaatccaagaagataaagtatctttatcatggttcctatgttagagttgagatcataaggagagaataaatcaatctagatttgtttagatgcttgatatatagatcaaatttaattaacaatcaactaaccttggatataaaatggatgaaacttttcttaacacgatcaatatagtcatgtcgtaactagcttaagaatccattgtactcacattgtctttatgattaaaagcctattttattgaaaaatcatatcttccatcataatatatttcaaactataatcaatatgtttgatcaattttaaatgactcaaccaccatacttctactgtgtcactccaattaaccttttccaaagttcttaatgatttagattatagttttgtaaactccaatcaaatattttgtttttctaagtccattggatcataattctccttcaaaataattgccgtatttacactattgaatgattaagatagtaacttctaaatttgatttgagtcaagtcaactctagataattactttgacaattcaattaaatgattcaaaaatcagtctatctcttttgaaaacatcaacttctaccttgtctatcatgatcttgtaaattactagagcatggtaattagaaagaacagtcaactttagaagatccactcaaaatatcagtaaaagagattattcttaataaaatatccttccattgcttagatcttgccatgattatagaagtctttcatactcccaatatccttctattaccttctttctattctctttatcaacaaaataattttcaatggattttctatgatatcaagattaagttcccaaaataaatccaatgctgatacaacatagtataacccatctatcactcaaattatacatccatatatcaattgtttagtcatgatttatattctttctaaaactagacttgaagtattcaaccaaaatctgaacaatataaaccttctatacttatccaaaacaaagttttaagaaactcaatttatatccataaaacaaaatcagacactatgaaacatatcattatacttctagtaccaataattatttttagatatttaatcaaaaccctaattctatcccactctcattaatctaagttctcatgatctgaaacctaagctctgataccattctatcaagctctgaatctaatatttagatcggacatgtgatggctacatactccttaaagtaaagtcctaaagaatgtgtaaggcctgccttcacattcaaaaatatcacatcaaatcattctagacaatgaaattaaaagtaaacctctaattttattgattccaataaaatatatatcatcaatatctcatcataattaagatcaatatttatttaaaaataaattaagtaaatattctctaagatcctatactctttactgctcggtctcaagctctatagaattctctgaatctaaaaaaaaatataaaaaaaaaagagatgagctttacaggctcagtaagttactaatatctataagggttcaagtataattaatttttttttcaaacatacaataatagatgcaaataccaatatatttgaagacaaaactatatatgccatatgtaattgtaagatttttaaaaaaaaatctctctcaatcttcatttactacagccatgatcaatcctgtgacaagattcaggagaaactaacctctaaaaatagaacatccgatccatcggtgtgtaccagtgatcagtcccactagctagatcgaggaggaaagtagctctaattcacacgactataatttgccccatgacaaaataaaaaaattagtcctaaaataaaaaacatgtgatgcatcagcatgtaccagcaatcaaccttgactgtctaggcccgggagaactaactctgccagcgatcagctccgactagctaagctcaggagaaatatatttctgacatgtggccaacgatcagtcctgttagctacacccaaatcatagtataattatagagtttttctcatgattttatcataatcaatttttcataaataatcatacttatttttgtaacagtatcatctcaaactttcatatcatcagaaagagccataaaatattttttattcaaaatttcatgcgatgaacatgtataagtttcttctcagaaatcatataacattaaaataaaaaaatcatctctttttaaattcgtaatcatgaagaggtgatgccatatttgatccaattttgtaaattacttttcataaataaatatataatttaaattttaataatttttaaatattttatatataaaaattaaatttttttaaacatataaatatatataaaaaataaattcaaagataagagagaatttacagttttagatcaattaaattcaaaaatcataattttggattcatggtctgttccttagatttgcactcctcgcgatatcaattttggcttggcaaatatggaaaagagaaaaatactcagtctagatcacgatttggacaggattgtaggacggatctaaatatctcacatctatttttttttaatttttttctctctctcctctcgaatctctcattctctctctactcttctctttctttctttttttttgtttttgtccttctctctggttctctctctctctctcttcttctttctttctttcttcccaagccgaagagatggcttttcaaaacggagggaagatggaggggtggggtcagtgatgatggtgcggtaacatcaaaaacatttgttatcattactatttacaatgtaataatacattatactgattttttatctatctccgcacccacctgcagggaccagaaagaagggagacaacttaatccctttccaaaattcagaaaagataaaaaaatatatctaatatatataattaaaaattatttagatatgtcagagtcatctaaatatatcaaaggtatatattttaggaagttgtgttgaagttaatttcaaaattttttcttttcaaaaatattttccttcactcatacagaggaaaaaaattgaatcagagtttttttagaaagccctttaattatttaggaatctatgttaaaattaattagaaattttttcttttagaaatattgtcccaatttttttaattattttaggaataatttcttggcagtttagagtgtacataaaaaagataggaatattgagctactttagaaagctgttgattatttttatgtatatagaagaaaaaattttgaagtaaattaatttgaataggactcttattaattatattaaaaattattcatcatttagcatctttatatctctcaaccatagccaatatggtagatccaattaaccagagttcgccataagcctgccatgaaaccatcatctcttgaccaattagtttctcatcacgtggccaggcttgaggtgcatggacactataataaaaagggaggtaggtgagataggcgatagttatttgctgatgctagaagggggcaccggtgggttgtgcaacaatattaggactttgtgatgcttttaaagcatgtcgaagaataacgatgcttttaagcataggaaagctttacttattctaagacaatgcattggaatgttgttatcttaaggtgctttaaaacatcatatcggacgccaatcaataccccaaaccattccatgttggctcttaatagaaatatcaagttatttgattcttccatgcacgttatgaaggtcaatgtggtcaactgcctagatggagagggaatcccataaaattttaattaaacgaaatgttttacggtcagccatgttggaaggtacatctaaagtcctgcccaatgttatagaaagttctgcacccatgttcttaatgatcagctccacatggattcatgcacattggctgctgacagatgattggaaggcccacatcacatgccttgatatgctgtggttcagtcttatcagcaccgggggtcaattatctactcaattcccatgtccttgaaaccattcctggtctctgtcttctttatattagtacctttcgatatatagatttaatattagtacgtttggatgcatggatggtccatgtctgggcattggatttctttactttctggacttctaacaattttgctttttcttttttcttcaatttctaactttccatcaatccgaacctgccaaattcctcttaactaatgcccccggcttgtacaaaagaaatcattgttgtgattgtttagtattttccaccgatttatgatctaaaccatgggttgtgtgtcattattggagcaccattagcagtagcagaaaaatatgtgtcatgtcagtgatatgtgacttattagcaaaatattatcttttaatttagtagattttttggtaatgtaatgtatatgatcttgcaaccaacttaatccaattaagataatgagtaaaataataattaactacaaatgcaattaagatagaaatggcattgataatttatccttttatattttttttactaaatgcaacattaaatatatattttctttcactttatataagttacaattttagtcatttttcttctacaatacacaaaaattggataaataagtcgagatccagcaaaaaatatttagatgatgtttaggattttattaattttgctataaaaaacctaatataaatgagaaaattctatattcatgcagaaatgtgtaaattattcttctctcaattcacaaattgttgaagaatatttggtgtggaataattttttgaaggattatactggataggtatttcatggggagtccatattatcttttgtacaagatatcttgtaggtatagagataatattcgatcaacctcaaagaaatttatacaatattaccaaaaatattgaacattataaattctcatcttatggaagagttttgggaaagatccaaagtattgttcttggctaaaaatcattggcacaagcacattgttatgtcttacttcatagtgacataaattatgagtattgcaggttagaatacttataacatgattaaatttaataccctatcatatataatatttttgactaatgatttaatatttatataatgagttcttggttgctcaatgatgaggcaacaataacattcatcggaaccccaagattgagcagaaatggttgattcagccattccttggatgacttttcaaacatgttagacatataacatagatatacgttaattatgataaatattttgattaattgatttatagctaattgtgatgttttttaggtaccgatgatgatgaagagtaattgttcagatgaattgatagccatcgctcgaggtcctaatagtattatcaatagatataatagttttattatcaataattttaaatttcatactgaagagaaaaaaaaatttagaaaaatctaaaatagtagagttatgatagaggcagacaaaaaaacttattgtggtatggttaagatatttaagggttagattactatgaaaagtttaagatagtattattttatacgattgggttgctgttaactcaccaagaggtttaaagcacgacacaaacaagtacgcacttataaacttttgaagattgatatatattggtgtactattaaatgatgatgcatttatattttcatcttaagctcgataagtttttttttctacaagactcaaaagataagaaatgaactatagttatcaagatgaaatttagggacttgtatgatataaggaaaggaatagttttgaaagataatgagacatatactcaatgtatatgttacaatattatgccgactactgaactaaatgatgtttgactcctattgataagaatatttaagatatatatttttatttaataaatagtattcattattagcaattcatctattattgtatttaaaatttgtattaactgatattgaattaattcatgcaggttagaaatatcgatcatgcctcaaaaatattttagagttatagtgttccagcattctcaaattggatcatcttccattcagccccatgagcttcaatagtttgaggctcacccttcaacactccagtagtctcagtagctaggatcttcatcatctacaagcacgaacaactactaatgatcgagacaaggaacttgtggtggatgacttatagatttaggattatttaataaaatttatttcaaatttatttcattgtgtatgatgcatatttcaaaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatttaaatatatattatagatgctattttatgacttctcattgtataacaagaattttttaatttttgtaatatttattgtatttaaatgatttgtacaagatgcacagattttgtacaaatatttataaaatactattttgatatcttttttctaaaaaaaaataacgatgcttattagcatcatagaacacgttagatgacaccttgtagcattactagtaaatattagtaaatgatgctcataagcaccgcccacttagaaacgttaattagtgttcgtggtttgtgatgcttttaagtgtttgtagttccttacaatgctttttaacagcattggcagattccatttcaatggttgcataggtgacgcatttacgatgctttcataagcatcatggactaaattcacgaagtgtcaggatggtccaaaaaaaatactgacctttctcttttgtcctatggtgggagatgcctaaatctcccgccactcggctacaactagcctataatagtaaaacaacttccatagtcatgagatatattgagaaatcatatacacaatattttttaaatgtgcaagtagttatctaaatagttgcctcatatatctagagctatcgatttgaattggactcatcgagttgacccaccccaccatataaataggacgagttggacttatattttagcaatccatttaaaagctggttaaatgacccatccgtttggattgtgggttatgatggattggggcgggtcgagacggactgacccctcttgacaactctatttgatgtagagctgtcaatttgggttgggctcatcaggttggcccaccctgtcatgtaaatggaatgagttgaattcatattttaacaatcaatttaaaagtgggttaaatgacctgccccatttgggttgcgggttgtggcaggtcgggacaaatcgaggcagatcggcccgtcttgacagctctacaaatgtctcaagattctatagcgataagttttggccctttcctatataaaatgctccaagagatttctccagataagtcaagtgaagctaagccaagaaaagtaaaaggaagttaagtgaagtccatctgagactgaactctctttcccaaactttatttgctctctatgctacttacatagcacctcccttgtttccttggaagtcatctatcttaggtgtcagaggatcctccactggatactttctaataaatagacttccttctttataatatttcaacaccgaccgtcgtattagagtgaagatccaaccactatcatccatcttccaagatcttcagctagctcctccaatccttgcatcaccccattaagtcctcacactagctagctcaacaacctagttagactaatttttgactgcaacagcatctatataccaaaaagaagaatataaaattattttagaagattgttaactaattccccacctcctctttgtcttaaattgaaagaacttgggttagaacatataccttgagcatttttgatcccaaaacaagtggaagtgattatatttgaacttgtttgaaggccctcttgtcctgcactccaagaaccacagccttgtgccttcgttgaatgcactccaaattccaaaagagagctactaaagtcctcttatggtgtccatgccttagatacccaaggcttttttagatggttgtcttggagaaagagagaaagtataacaggaagaataacgtgtgtgtagttaagttgtatgtatagtatgatatatgactgacatacaccatctatttatagaagcatggaccacaatcccactctcacatgatctctgtaattggaagttttttgaaatcctcaacatccacttaagataaaactgagtcaatataatccactaggatatgactagaatttttaataattaattaattaattaattctaatatccacatttgcatacttatctcatgtagatgtattggtattctatatcaatgttaataatctcccactcggacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccctgtaagaatttggatgaggtctacctgtaatgggagctcaggactgaagtctgactcccgtaggagctcggacgaggtctacctgcagtaggagtttggaaaagaagtccggctcccgtaggagcccggataaaacccagaaggtggtcgaccgccgtagaaacttgggtggagcccgtccgtcatggagatctactgttagaaaagttcgaccactgacgaactaatgtagttctggaagaaattcagattggagttgatcgaatcctgtcgaaaaagattcggaaggggtctggagaatggttgacccttgtaggagatcgatcgatggtagaatccagaacgcacttggagcagcttgatggacaaccgaagaagcttattgttggagaagcctgggagatgcggcaggagtttgtccgtcgggggaacccgatcgacactcgtggaagaacctgtgggagtttatccatcgatagaacttgagaatattgcggaagctcgaccgccgaagaggttcgaaaagatgtcgcccaagattggacatcggtagagtcccgggagagtcactcctggtatgaacttcggctggagaggtattttatacccaacactagtctccctactttcgagttcgagtttcgaatgaagtatagagaaatttttacagccgaagttgcccccttgaattctgcgcgcgaccgccctcagatatcctggcatttaatgcgcgcatgtcggagtcttttcaaatcagagcgatccgaagatatttttttgaaactctcactggagcgttgctctaagtacggcgcaataatggccttgccagttgtcagccgcttttagccacctactgtggcgagtgggacacgtggcgaacatgggtcgacctgggaaaatctgcgatcattatagcgccggatcccaaggtctatttaaacccgcccttcttccttcgggagttccattctgcctgaaagtcctattggtgcccgtcttctttctaagagctctgaccttcctcgacgtccgttttggccctaggtgttcatcgagtcatccctgtccctgcatctctacgtcctccgaagcagcttaggttagttccagaactttcgttccttctctcgtcatttaggtgttccttcttcttcatttttcttctgccgtattccacctgtctagttccccatggatctttcgtctcttatttctcccgacttttctgagatttttagggttttcacttgaaatatcttctggcacctctgcctctaacgatttcaggagttcgtctgcctcagtccctcagaaccctcatactgtagatgaacccatatctagggctggacctcatccagtttttgtgccggacgccatttcttattttctgactctggacgaacttctactgataaggattcagtatggagtttctccagagtacgatctggagcttcctgatcccgccgatcgggctagcacccccccacctggccatttctgcctgtactaggaggccttccgtgttgggctccggctcccacttccatccttcgtcgtcgctctttttcgtcttctagacatttctttagcttcagtcgcatcgaattcctttaggtttttgataggattcctctttctttgccacatagtcgaagttcaaccatctcttcctttgtttagattatttttataccttcaaacatcatccctcgacaaaagactggtggtacttctccccccagttcggcaagaagggattgctgaaaggtgctccctcttccatccataactggaagaaaaagtacctctacgtccaatgtccgaccttaaagctgggattgcccccttggggcatcctgagggactccgtccgtcgggctcctagcctgggggaggacgaccttcaagccgcccaaaaacttcttagttatccaactccttctcttcccaaccttctgaaggagtaatttctgttcaacatcggcttgagtctcttggattctacgagtattccatctttccttttcttcttcttttctttttctctcccccttcttctttttttttttaaccatgcgtcacctctttcttttttcactctattgctgatctctttttttttcttttttttctttcttctttttttttaggaatggacgccgaagcagtacggatgcttgccaagggcctcaaggttcataaaagaaaaggtgctgcggcctccgagtcggcaaagaaggccagaatggaggagatgagctcgaccatgcctgcccaggtggccctcattgtcgatgttctttcagatgccgagccccccagttcccccgagcctcttcgaggagttctcccagccgaggttttcgcttcgggggcccgctccgaggaggtgccaggggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatatctttcgaagtatttggttcgtaaccagaatcgaaatcaaaatatatttgaatccttagaagacagataggattagattttattggaccatttccattctgcccaggaattaaaattagaatcgaaatctccctaaccaaatgttagagtcatccatttttcattcccatttcaagccccaactcccctccaattaaataccactaagttttttcacaaaagatgactcaaaaatctatgatgtccgaaccttagtagcaagaaaggcaatgtaccgtttttttagtatttgcttgcttcaagtatttctaaaatatctgcttcccatcacccgcacctattctagctcctggttttggcaactgaactcgtatccataactccaggttgaccttttcgtttaaactattgaaggactcaaaaaggttaaaaggatagttacaacattgtaataataactccagttccaaaattggtcttaaaccaactataatctcatatcattatcaagtaacttggttatatattgccagccacccttacatattgggatggttcaggattctcctcctatgagcttaaatacattgcaccatgttctaataagcacgtctttattgcatttcctttgtgatcaccctttgaatttacctttaaggtgcatttggttggcaactggaatcggaattaaaataagatttaaatacttaggaagagaaaggattgtgttttgggggattgggatatttttattctctcctggaattggaatggaaatagaattctctacggccaaatgaccggaatagaagtcactcatctccatttctattcctgggtccaactctctccaaccaaatatatcctaaacttagatgtccaacaacaataacattcaaaacaattgtaaaatccataggaatgcccaatgccacatctaaagccccaaggaatctcgcaacaatctaaacccaaacaatagtaatccactataaaatcccaactacaactgctaaactggcaaaacctccattaagcacagccttaatcatctcataaatccaataacaagtacatgtaactcttagaaataagtaaaacccaatagtaagctactgctgatcaatagctcatatactccatattggacataagtatgagtagataaatcccatactatcttatgtgtaaatgaaatctctcagcttccaaagaatattttagctttccatatcttatgtgctttgatatttgaatatgcctggtccccacccacatccacacgcgcccaaaaacaatggaaaacttgcattaggctcttccactgcaagaagatcattttcaaaatttatgatcttagacttcaaaaaaattaaaaaggactcaaaaaacctaaacctcacaacttcatggtaaaaccaaatatataaaccacatgcatattctttgagcctttgtcttagttatacaagtagcctatagagatcctcgtgggctgacaaagtgacacactattgacagttctgccaagcaatcctttggcactcgatcgtgttcaacaccggatggatattctcttgcttgcattccctgcatggttttcagaaacgatgaagacgtagagaaaaccacaaaatccatgacatgtcatgcacgcaagagatgggtcttggttattgttcaaaagtcatgcttgttaactagattaaccaatgcaagcagaaattctgggacatggactcgtctatatccaccttatttttcaaggaccctaaaggaggagacagatcattattagtctgtcatattaccctcttggatcatagtggcatggggatggtctcccttactgtttggatcctctcacaaccatcttcaaagaaaaggaaaaggagactgaggaacaggattgctttttgattacatgctcctttaacattccaacaatttgtgctttaacaaaatatatttcttgcaattcctgaatgtctgtatgatgcctggccaagcctagtattacttcaatcaaacttgatgctgccttcatattctctactataatctgcatctcaccgacaatgcagattttaggagtttgcagatacttgatgattataaacctgaaattatataggaaaaagggagaatgagaagaaaaagtacaagaacatagagaaccttgaaccacttggaaagagaaagccactgatcttacaaaaggcattctatgtgtgaatccacttgaacttctatcatacctcaatttcctggaagaaaatttatacaactccattgaattctaggtgacaaatggagaagcaccagtataactgatctgaaatagatagggaattatcttcttggtgttcttttttgtttgtccagttttcatgctttttttaggtggacaatgttcatgtagttcaaagttttctcttgtacctgcacttggtggacaataattaagtccggttcaatggcaggtccgttttcaaaactcattctctccttcttcagttatatttatacagaatgttgtttattcctttacagtttcatgagaagtgagagtttcataaggtcatgctatgggactttagaacataaacaagaagtttgaaaattcaagtgattctaaaatatatgtcttataaaatgataaacaaaaatcagagtcttccagatagaaacaaacaggcttaccaaagactattaacagagaattggcactagaacattcagagacccaattcaccaaaatattgtctcattgagttgtattaagaatctgctcctggtaccaatgcagtatatatgagaacatagtagaggtcctctaccacccctacaatggaggcaattgcataaacttatgccaaatattttaccaatgttaaaaaacttgacatattcagagagtaaaatgattgtagagatcagtcgttcagtactatctgatgcacacatagttcgcatcaaatcatataaaatgcagattgattcctatcgtagtttcgcaagaacattgttgatttcataaatcaaacaaaacacagaaataagaggacaccaaaaattagacagaaaatcagaagttaaattccaaaatggggggatacaaatgatgtccctagacagttctagaagtaaaggatacagattctagcaagaactttcaaatgtattttttcacatacatttgtaaagcttgttaaactcagaaaagttgatggtgcacattccaaaatatagctaaaactctagcatcaaatcatataagaaaacaagaacttccaaaactcggacaagacacatactttccatgagaatatatctacaaagctattctgaacttgaagaagctgacatctcaagcgtcaaactaacaagcttcaaggggattttggatgatgtatgtgcatgcctgcagatctgcataaatttgcatatcatatgtgttaatggattcaaatggatgaaaataattaaaattcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaaaggcgaatttttattaaaaggtgccaatcaagccattgagatggcatcccagcagaacgaatttttgcttccaacgaagtgatccagatttaaatctcaatgagtatcagattatgattaaatgtcaggatgtgaatgactgtgaatggagtatatcttgatggtccggacacgatatttgatccgttagctttcaataatattgggatgacgtatttatccgttggattcatccatatggtgaaaaagagaccgtttattcatccggctcaaaattagatattttttaataaaaattgagatcctatgatcgcatcgggagaaagtggatgcatccgattgcgtccctccaactctcatctttcctgtcacaaaaaaaaaaaaaatgccaaccaaccaacacaaaaaccaaaacattccgggtcacatttcttgtctcttctttggtcatcaatttattatttcacgtgggctaaaacaaaataccaactcgtttgttctttctagaaacatgtcctcaggattaaacactcacaaagataagcactaaacaaaaatgacgtctccatggacaacccatcattgcgtccacccaatatatgctctccatcaacaccattagtcctcgatcaaacggtcagaggatgtttgctcggaacttttagggaacaagggaattccgcataatggtaacgtctcaaagcacgaacgacggaagacccgtcaaaacgattccggaaaacgacagctttccgttggagaaaatcctaccgtattcatcgcggaagatttcctccccttcaagacaaggtcgaatcctctccatctcttctcgatcagacggatcaaaaaaaaacaattatggactattatcataagttctcaagtcaaagggactgcttctaaattatgtaccgtcatatacgacaaaggaaacattctaatttccaatgaaggcagggagcaaatcggaaaaaaaatcccgctctgtagtaaaaggccccaagggccaagaagctcttcatggtaaatagaaagcggaattcctttggaattctactttcgttcttcccctctttctcgccggcttggtggagtctctcttcacctccgtttcccctccatctataggttttggtgagcttttcttggggtttggtgcgtattctttgggttttcggctcgaattcgaggggaagtgatggatttgtgacccttggaggagttattaaagcaatccttcgcttacattcttgcatgcaagaaaagagatggagagatttggtcttaatttggacaaaatcggaaggtcttaattgataccaagatcccctcctgctggtggcggaactggagaatctccgggcttggtcaccctccgacgtgatccacatcgaccatcgcttcgtcgcccgcttcctcacctctgcctttactcccttctcatcttcttggacgccacccaggtccgctccaaacccgacctccgcttcccccacctccgcttcgagttcgccctcgtctccttctacaccgcccaccacaccgcctcttgccacgtcttctctgcggcatcgagtttcaagaatcctacgccttggtctcgggagtgctttggagtttggttccgaagagcttagggggaaaggaagcatctttttgaggtctgttttgtggttttggtgcgttttgggaaggggaaagggataggacagatgaggaagacgaagaagaacaaggaggagatagcggaagactactgtttcacttgcaaggatggaggacatcttcgagtgtgtgactacaagtgagctcggtttttctccttctattattgtagaaatttgcttaatgtttgtattaggtttcctttatttgatcttcgtctctatttctctctattggtttgtatatatttcaaattttggatatttgggtgtgaaaaatatgacatgcattttttttaatatttataaatgtttcgatattacgtaattaaatttctgctcatttttcccctttttcctatgccctacaatcgtacctctggagaaatgtatgtgcttttttgagtggggctgcttctctatgccccaccagttcctactgtttagcccttcccgtatggtgactcgcatgctagttttgcttggtggcacggtaaatgttgtgctgccagtgtttcctcaaagtagtctttagcatgcctcctgcatgaatttcttgtccagttgaactgcaaaattagtatgagaaagttgtagcagtttcatcggcattgtttatcttgtgtgcacacttcaagcattagaggtagcatgtccatttcttacgtgacactcgagcatgcttttgaccattccttttttactgttacattgatcataatacaaacattgccatgttctttgggaacttgatttctgcatttagcagaatgcagactcaatctgtctatatctttaattaaggaaagtcactgctcatcttgcttgatgtttgcttccaatgtcgggtaccatgaagaaatgcacctgattatacgccaactgttgttcatgttgatcaaatttaacaaactttcatgtattgtctattagttgggtggcttttaaattataccttcaattgaaaattttattggtcatactgctctttaaaaacaaacaaaatttatgcagagtctttttataaacctttacatggaagtggcacacctccatattgaagctaatgttgtataacatccaggcgcacattcttctggtttttgtcattgtccttgagttaaccaaagtttgtattgttgtacttcttcctcatcttacgttgcatgttcttaccattctcttccaccatgacggaaagagaccaaaagaggaggggtcccaattgcatgcattgtattatactagtatttgcatgaatcagttcaaacaaaaggtactcatctgagcagagaatctattaatgagtttttatttttgacaaggactcagttttaatattgctttctgtagtttaatttcaattttctgcttgaaactgttaaaaggaggggaattatttgagtaaaattctaaaaggtaaagataagagcttcagtctttcttttttaaaaaatgacataagttaaaaatatattttaaatggtttgggttcaaaaccaatttgtgtactaaaaattattcagaattaaacatattcagaaaaaaactacagaattagaaaaatgggaaaaatttaaagtgtgaaacaagttaaaaatttattgaattaatttcagcataaaatattctatttgatgataaagtctttatatagacagacaagacatataagagataactctatggcttgaagtcagaagctatgaaaaaagtaactagctatctagatagtacctgaatattcaaagatattcttcataagaaaaagaaaagaaaatatgtacaaaatgacgtacattcctagcctcagctaaactttgccaatccttgacctgaatgattctacttaaactttgaataatgaatatgatttctaaaaacaatatgtaagcagacctgggcatgatagctgatgcaaatgctaataaagctataacacaaagccacttttaccaaatggagctccggggcaatgacatttaattttttgatctagtgctgttgaatgtctcaaagttgctgctaagcctaatatatctaatacataaaaagatattcattgaacacataattataaaaactcagaaatctgtaaagaaattaaaacaataaagctaattaatttttttttttgaatttataaggggatttattctagcaaagcatgaatgttagcaagtgctataaatataataatatcaattaatcagctaaaataatatgatcagtaacttaaataaatgaatccattaggcaacagtaccaaataagaaataattatgaaacagttcgaatcaagcatttagtcaaggatcattgaaaggaaagatttacatttatacaaggattgttctagtatagcttaacaagttaccaagtatggtgccaatttttacctatgagccatgcaataatattaatctaacatgattagtaagttaaataagtcagtaggccggaataattgatgaagagttgggactaaacaatttgtcaatggtcacaggaacatttggtttaagttgtcactaagctaatgttgttaggttaccaacaggaaaaacaaatgggtttgtaacatgcaagctggacccacctgatacgccaggctgctgttcctaaaacctgacttcctcaaagtgacatcttgattagcttgagctgctgaggcctaagcaaattgcttgagtgcctgctaagtggtcaagccactgtcaggggctgtttgggccctacatgggatgcttagggtacacctaagcctaggaggctcggataagtgcctgtaaaaataccacttattgtgatacttcctgattgtacttggaattaagcactatttttcttagtgcttatgcttttctatgaaaactcaatggaatgctgacataagactttaataccttcttagtattgctctattttcatagctttatttctacaccggacaactttgcttctttgagctttattaaatatcagcagtctttggatcttcgatgcctaaaagatttgtcatcttgttccctctttgttaaaatgaatggtggttaaagcgcttgttgttggacatgaaattagttttcataaatcagtctgcttgctttcttttgataaaattggcctttatgcttcccttgtgaaggttattcatattaagctttctaggtggcgtgagtatttctgtttgatattggtgtccactcaatgtcttttgtgggaaagcctgcatgctagaactttcagattggtcatgctacttagtcccaagttgttatcagaaatgattaagttagaaaaaatggattctgatctttcatacttaaactatagtaggcatttattcctcataaataatgaaatttgcattttgcttggttctttgaccatatttagttgttcatgtttgtcttattatttgcttagattctacaagtacattgcataggaaaactaaaagttgttggggcttcattagctagaactgtagaaagaagttatgcattatgatttttggactgtttgctaactggatcacaagataaaaatttcctaaaggctacagatctgagccagatctgagtagactaacaaatatgaaaattttggaatacagagcaagatactaagaaaaaaaaaacaggtgaaaaggagaatagagtagcagaagagaggagaagaggaagagggttgcactgctagaataccaggccatgcaccctatcatttgccaatattagggcagtggtagtctagggtatttcataagggggtaaattagtagttgatgagtccattagtttttgtgaaatttagttttaacttatgcatttattatattgtttaaaacaaaagaatcattaaatttatgaaaacttgaagtggattgaactatagtactatgctggtccatatcatattggtattcctcttggtaacatgacatatgtttacatggtattgcatctcacttttcccatgccaacaccaacagacatatcatttgttggtaaaccatatggtaaggtacctatacggatacttgtacttggagtttaaaccatgcatatgatgctcacaatgctgtaacatagttcatgaatgagattatatgagcaaaaaataagagggtgcaccttgtgcaggagaagtacttttctgttaataatcaattcccatgtcccataaaggaagcaggatcaaaaacaaatctagaggaatgataatcaaatttgggcaattggcatgaataatgaaaacacattagcgagaaatgagatgttgcccctaacaggaaacaagactagttttcataagttcatttccaacatatgtaggatcacatgtaaatttttgttttcattgctttctcattttttttttattctcacttttttctcagcctcctcccttgtacccaactcctcccccacttatgcgtcctttacttatatgatataggccaaagagtctagatcatggactatcataccaccttgaactgcctggttcaaagtgttctgtatcattcctggttggaaatggtataaaaattgtattagggtcactataggcctcatactgacccgtatcaaacttgccgaggcataccaaggtgaattggggtgtgcattgatccatactgagacatgctgagataaagcaagaaaaatggcttgagagctgtcttagtatggggtgtgtactgtctcacattgatctgtaccatactgaattggtaacgtatgggtatgatacttgataccaagattgtggaccttggcctcgatattattaaattattgaaatcttggtgatggaggtccttatctgctataaggtctttccaaatagttttaaccttattgctgagtcaggtataataacaactgcagtgggtcccacttaattccatttgttatctcctaaaattctggtaccatgaaaatgggaagcggagttaaaagatacttacgggaatcaatatttgtttgtaattgattacattgatagaggtaaatccagatggaccctactctattattacgagatttttctgaaatttctcttgaactattggggcaagtaacctcctttcccttgcattactattggatgagggatactggtaatgtgtatatacgacataagtacacctatttaagatgcttgctaactttatgtctactaccactactataaggcctggtcagggccattcaatggatcccttacatggcctaggcaattaggcagccatctaggaaggaaaagtttgaaaggctgtaaaagatacatgtgatgtttatatatggtacatcctcttaaataaaacccttgctcatcatacatggcacaacaaatgttttctgtattcaatgaatggaagaactaaaggataagagaagcaatagcaatagcttgctggctactgtagcaatagtaagcagtagatggtagtagttgcagggccagcactcagctattgaggtggaaatgtagtagctagacaagaaaggagggacagagaaacaaggcaccaggaagatttagggagaggagggaggagtaggagaaggcagaaatggaagaggaagaggaggaggaagaagaagaagaatcagccaactaatgcaacattttctattacgtgtatgttaaattagctcatagatcgagtgcaggaatgtttctaccatagaaatcacaagtattctacaattaatctcctctccgacaaccacttggttggtggctggggcagggaaacaaatagacaaacaacctaacaaggcaaagcttgcaagatggaggagccagtcgggaattggaaaaggttgggaataccaagcagcttaggcctaggcgacccagccaactaatgtaccaaggtatctgcctgtgcctctaggtgaacacctttaacaacattttgtataacatgtatgttaaattagctcacagactgagtgcaagacattcctgccataaatcaaaagtattctaccattaatccttcaactcaattgtacgcaaggtttgaagtactaaagtatggggagtcctgttcaggtttcggcacagtgcataacgtaatacactcccttgtcgactcataatctgtcaatatggcacggacagcacatggtacttgctgcgggacataccttagtatgcctcatgaagtatcatggtacaatcagttttttgaaccttgattggaccaacgagaaaaaccaacaaaacatttttttaacatttttgtcatcattttgaaatttaatgaggattttatgcatggggcaaatatcaatttctttttttgggaaaaggagggagtgctgaaatccaccgactgggagaaagagcttacaaagagaaggttcccgactaagcactcgagttggcccttagtctgtcacttatagtggtaaactttgggcgaaccaaaagcaacatgaataaagaagggacccaattggaacagtgagtaatggtaatcttaatgacgtaaagaggaggcttgtgatttttaaggaaggatttaatgttcctctcatttcaaatgcttcaagtgattgtgatgaatagttgaccccatgcatttttaggatcttgtggaatattcataatttctcactctgtaagcgaatactaaggatagatacagagaaaatgtggctctagacggtattagtgaacaagccctctgaaagaaggtgatccgcagtctttgtggtggagtcccacatcaaaaatctaaaacaaacatgttccctaactcttcctgcaatgaagtatttccttagtagcaagccgtataaaaattctgaccataataaggacaataactttccatgtggggaaaaagtttagttgaggactcttctgtggttgaggaactgttaaaaatgattacattgagaatatccctgaagaatcatatatccaacaatataggttcctttcggatgctagtagagcaccttagagaaactaaaaaatttggacttccaccagtagataatttttcaaggggagatctagggagtggttttgactaatatttgaagcaaatcattatgatgctattgtcgcattgtcattctagtatcctttgttgaggcttcggaaagtgctgctgctcaactaaccatctaccttttgaaaaccaaacaaaccttattgcctatggcaagagagagcgtggtctagagatttaaattcgttccaagcttgcaatgctttaaagatcttaacaattcttgtagagtttgtgtttactataattagaggcaagagtaaatttatgctaaagtgcaagcaattttttttgggatttccatgtcaacaaagtcatcaaataccgagtctatgaagcacaaaaatgcatatgtcaacacggcaaaccttgaaaattaggagttggggaaggtctggttggtgcagtcactatgcttagaactctcaatatcttggttaagggggatacaaagatggtgatcacttggattttttgaggcacccattttgttagatggacaccttatgtcgggagacttgaggaagctgatatcgaccttgtttaaggtagctcatgtctatagggaggctaacaatgcaacagactaggtgacctcatatgtcgcaaattatactagcatagtgatatgggaatcactcttaacggcacccctgcttgtacgtgattttgtattctaatgctagtggctatacttttgttagggtagtgtaattgtgccgcatcaccaaaaaaaggtaggatattgtattaattaggataccaaatatatacatattttatacttacatatacgcacatattcatacgtaaatatgatacatatatgtgcatatattcatgtatgtatttatgtatgtatacaaatgttcatatgaccatagtaggctatcaaagtaacattgtctgtagactccgtactttatatgaaagtatcaacttccagaatctcatcatttagtcattatttaatttcatagacctaatctccatatttcatattgttatgttaatgccatgactttgaaatttaccattcattattatagggttaacattttcttccaaaaaaaaggaaaatgccaccttcatatttgaatgtatttgagaagcatctcaagagtattttggatatattgagagcaaggattgctgaatcagaatcgaatgtcgtgctggctggttggtagtacggtttggtacggtttcgtatcggtccgtgctgggctgaactgacagggcagagaaggggagagcgagaaaaaagagtggaagagagagagagagggagggggagaaggagagggaagaaaaagagggcctctacaggccgtcggaggtcgtccgagctcttgctgagctcgataaggcagagggagggaaggatcaaaggagagagggggagatcctccttaccgggtgtctggaggttgttggaggtctttggacagacggcaccgccgccacaatgtctctgatggctggcgagcaagcgacgaagggcggctgaggtcgaaggagctggggagggccttcgtggtggaataggagttcacccctgttctatgttttttttttcgagttttattgcatgaaattggcaacacagccatattttatcattttttggttgcagacttcaactgaattttttttaaaaaaaagataaagtacggtgaagttggcaactgaattatctatttcgcatgatgaaatccaaaaaaatacggaacaggggcgaatccctattttgtagcggaggcccttctcggctcctttggcctcgatcacccttgctgctcgctcactggtcgtcggagacatcatggcggcattgtcatccattcggagacttttgacagtcttcggatatccgatctctctatcacttcctctcttttttctctcttctttcgagatggttgtcgtgccattttctatgtcggaattggatcggtttcccaccggtatggctcggcatggccaaaactgtctagtttgggatggttcgaaaaatgttgattgagagtgctttttttgtttttatctttttttttgatagaccagacgaatcacacaagtccagtatgaatacatctaacaaaatcagaatataaaatgatgcggaaggggagtgatatggtcaaataatcaacccataacatattttcagagtactcagcaacaaaagaggcaatccagtccgcagctttctttgcctcttggtagacatgactagcctagaagacgttacagtccctcgcaaaatgccaaatgtcctataggaagggatgcccaaccgctgcgttaaattgcctctggatctgaccaaccattgtagctgagtccctctttaggtggatacacttagcccgcaaccaaagtctagcatagctaagtccagcccaagcagccctcaacttagctccagggattgtagtgtcatgtatttgactaccactagtagcaatgaatcgagagtcggggcctctgatcacaaaaccattgtctccgctgtagccactatcagacacactatgatcaaagttcaccttaaggaagcacgggggtgggggctcctaggtgataaatatcatcgggttgctgtaagagctgaaaatgatacaaatatagaagatgcatttgagaagtgtccgacacatataggagacatatcgagttttggtatgctcggtatgaggtcagtttagcgtatcgttactagtatgatattgctatgctcgatacattgcagtatagacaagtatgtgtcttatgtatccaaaatggaggcaacatctgatttgaagtatcttgcttcttaactgattgttagttcaagtccagggaatgctttaaggtagcttgaacataaacatgattttaaaagggaaagaaaaaaattgtatatagtaaggtccatctctctccctcaagggttagcatgttatgtttttgactttccggtctcttgtctgcctactcaaaaaagcattaccaatcatgttgggaatctactcaatgaaagaagatcctatagtaagttagaggaagtgcatttgtcatggacaaaacaagaaacaggaaccccctctagaggcatcatcccttatggtttgaggtaccccggaacggacgcataccagtcacatactgacatgatgtgtaatatcaactcaggtgtgtcaatatgcctccatacagaatgctgtacataacttggtatgccttgataaggggtgtgttatatcatggaacagttgattcagccatatatttaacaaagtctttcttaaggtttgataggagctcaaagtacttaaggattttgtctgtctaggcatgaaagagaaattgtcgtttgaccatttgaagtttaaatgccaccaaaggaagcacaactattaggcccaatattggttgacttaagcagcaatattcaagctatagaaatttcatcactagattttggtaatatggggaataagttgctacatgtgttgcacctatcaattggctttacagaattatatctttgtaactatattcacatgtcattttatgttggcaaggacctacttcatagtctattccgagcttgcagattttgtcaaattatgttattatgggtctaaaactttgtattgaggccttttaacaagtttggaatgtagaatcgtctttctttctttctttttcttaggtttgtttgatatgattgagatttgatttatttaggtcagcaatccgagctgcttttaggataagtttgttgaaccctatgaacaagcatgtgaatttgttagaaaactccaaattttgaattgcgataatgttttcttcttgttagctaaatttgtttctatggatttaatgcttgcttgctgctgagttagatgacgtttcttatttatattatattgctttctcaacttttaactacaagtaaaatggcacactgtttatgtcctattactcttgcaagttgctgtgttggcaatgggttgggttgggtcaagaaacccactacttggacctgggtaatttggcaaatgtgaagctggcccatctattgcatattaacccaaacccagcttgcagatccacttacaaaaggaggggaacaggggagggcgaggaatttgtgtagtttgctattcttggggaagttgcagctaccacttaacaatttgtaaaaaggtcagcagaggcagttacaatgggttggtggagcctttggtgcaaggggtttagtggtaggttagggtttcagcgggagagataggagttatttttaggggttataaagaaaatgtagcattgttttaacactagattattagttttaagtcttcattctgttatattcttcttcttcttccaaaacatgctttaatcttttctattattttaaactaaaatatgtaaaatcttgatgaaagacatgttatgaaaagggtgatgaaggaatatgacttgatggtacaaatcaatccttaggtgtaagaaaaaaattgaggtacccagatggagatggggcattgccatgagcaggttcatggttgcaaaagttttccttaataaaattaacattgttgaagagttggttactttggcagagctaatggttttcacaaaattgatgcatcattgaaagcaagccatgatgaacaaggttatctctgatcagtaatccatgggtaacaaaaaatagatattataaagggaaatcaagctgccaggagatatgaaagagtgcccagctatatactaatttaaaatggagaaatacataatatagttgaaggattttttttttttttttaaatcttccttcctttctttctttttgggtatttttgtgtttaaggtttatatgattcaaattagggaagattaaaattattaggactctgaaaaagattccttttagaaacctaaagaatatgggaacctattaagtgggttgttgtgaaaagagacccctctttgaatgtcgtattttttgaggaagcaacaatagcaagagaacatgattagctatcatgaaaaagaagggcattggattaaaataaaaaaaaatcaaggtggggttgttggtggtggtggggggtgggggcggtggcgctggcatggcaggcatgggagggcaagctaaggtttggagggcgcactccatacggaacaagcattacatggagaaggttctgatcctggaggagccatagtctcccttgaaataaacattgctctgcccctggcttggttgggtaaaatagggagaggtggagggacggagaggagaagagggtgggaggattgagcatttgggtttggacaggctaggtgttggttaagagagagttggattaggggtggttttatgagataggtagttcctgtggaaatagggaggagggggtgagacttctgactttagagagagagagagaggtgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagactctgacttagtagagagagagagaggtgcttggggaagtaggcgaatacctaggcctaacacctacaggaaggttttggagagaggaaaatgcggaataacagtctctgaaactacatctttttttcctttttcttttttccccatttttaaagaagggacacgtgattggagggacataatgaaactcatgatttttccttgtctttcaccaaagtaactactccacctagacaaatcccgtgcctcttgaactcttaacacttgggattcccctattgacaaaaaagggtatgggaaaaggccctgaaactgatcaggttacttggttagtcgcagacaacccaaagcttggcccacacattgaaatactacacgcagccttgttatttcaaatgattttgagttgaagattgccattccaacaagtggttttgtttcgacttatttcgtgtgagttagtagtactatacactagttatcacaaagatcattgtcgaagtttcatgaactggtattaaggtttgggaagaaagagaatttattagtcatgaggaaagttgctagtaatgcataaaaaccaaaaatcattatatgcttttgtgggattcaattattaaatatctaaaacttgtattacatggcttagtatcatgattattaatggatggttaattttagaaaactatgtgcttcagggaattcaataaaataatgtgttttacattgacccaatgtcatatcatccaaacttcaagaaacttgttaacatagtaattgctccttataaaaggggtagaatttgccacttcaaaacttcaacataataaactggtagtccatagaccttttgcaactattgacaatttgacataaactttgtgatcaggctcaagttattcaaccacaccctcttcaatgacttggttattgtttttgctgaattaggaacttgttttctgttatgtaacctagtgttcaccaattatcctgttcacttttgctttgatgacctaatctactcattcccactgaacctcctcatcaaggatcattttaatctagttttataactgacttaatcatctttcgttcaacatccatattaacgcataatagtcaattacaacttccttttggatgcataccgtaatctctttaaaatgccatggattgtctggttgccttttaatgccaaaatgcacactcgccatgttagatgcttttatggtagcataatatggtaggtctattaatgtttatattatgctttatacattatggggacttcagctgggattacatggttatgatgatctccatttaatgccaaaatgcatactggagcatatcttcctcattggtcttttttgtgatagctttaaatgatacagttattcatacttatatgatgccttatatgtaaagttgcttactacattgttcaattcctttgacagccatgttcaaagttgctgttgttgtaaactgacacgagaaacgccacacagacttaaagaacttatcagcaataatgcataaaaataacaggaagcagagtaaagagtacagaagttaatttgttcaccttgatggttttttcagcgttcaaagaagataattccctttgtttggttaacaagacgataacccctttaaagagccccctttagatattccttataacattttactataacttgatattctacacatttttaacaatatcagatcaagttattaatgtccatcctaaaatggtatctgatgagtttattcatgtctggtagcaggcttagtgaaaccaatgagtatccaattactgtggggcaatcaacagttggcattaagccattcctcatgttgattcaatacattcacgggtactgggttcagttaccagtacacaatttctccatatgtcaaccaattttgtgtaaagttggcattacaaatagatctgctcgatccttctgccgaaccttcttgaatttttgagtcattctccacagaactccaatttgacaataaaggcatagttatttggtcgaatgattgatatctgttagttacatgaagtatgcatattttggagcttttggtttcggcgatagtgattatgaaaatatgcatgtattaatatgcatagtatgtgtatcttctctaagataataattgcatatgccaaaactttagtagtacaaaaggtttatgcataatatgcatcacatattgctaaatcagctttctttttgtatcagatttggattaattgatatcaattctttattgatttatttggaccttctgttttactgaaccttcaacttgataaatgtctggtctaccaaaaattatcgttcatcaatatgatgcatttgtaaaacttagaaaagcattttttttcttgggcaacaatctttatattcccctcaaaaaggttggtgttctttatatctcagaatcatgctgattttcttttttccaggaattgtcttaaatcttaccatcctcaatgtgtggggaaggatccttccttcttggagacagatgaacgttggacttgtggttagtaatttcctgtagttcttcacatctttgtttatcaattagttttctaaacttatctggatttgagacatgatattttaatcttttctttgacatcacttttataggatagtttggtgcattatgaatgttgtccaatctattataaattcattgtgtgggaaacagtgccaatggattcaatcaccaaaatctgagtaagaattttttgatttaagcagtatgggaaccagaataattgatttgctgcttatcaagctctgtcaatcacatatttgttattgtaggtttaagaaaattgatctggtggtttttacatacagaaataatgtccaatgcaaaaattgtatgtagctgtcagaccatgtgaaagtattaaatgactatcatctcttttatgtgataggatggcatttgtgcttcatatgccaaaagagctcaagtttccaatgtttttgttgtccaagctcagtatgccgcaattgtatcagagaagctgagtttgtgcaggtgaaaaagaagatgaagggcttctgcaataattgcttaaagctggcaattctgatagaggaaaatattgatgttgactctgatggggtaacactactaaataagcctcggcaaattcttaattgtctactataattctattgttttgatctttgttatttttgccttaaccttgtcaaatttttcacttgttttctattcatatatgcttggcttctattagcttagaaaatcccatgaagatatttggcaaaaagagaaaaaaaaagaagaaaatgataaacatgacgtgatgtattttcaagtttgaacataatgcaaaaagaaagcaccgatagaaactaaatatcataataataattgatcgattattcatgagacattctgcaattccaatcaaaaagagatattttctgatcagatttgtcgagaacaacttggtttcatcacacaatgatccagaagagaggaaaggcatggctgtacataaaacctaacattatctgttgccaagtctaactcagtcccatgaacacaataaagtgataaacatttaaaaaaactttggagagaggattttatcttcatcaatgaagtccttccagggaacttttaatgagagttgaggctttttgttgttgttattgttgttgttattggaaacatgaagggagacatagatatttcagtattagaggtgtaatcaaatagacgtgctgcagacttgaaaagaaaattggaaaaaagaaagagatgatatacagaacatagtcacaacaactgctttctcattttcatttcttctagtcttcttctttgactcctgcatgggtagaatctagaaaagatacataaaatattgaaccaaatttgcggaggctttacatgggactagcctgtttagtattttgcaaaagcgacatcaagctcatgctattgaggaaagagaaatcttataaattctacactagtgaattgtttgtgattttgtaataaaaattatattggcaagtatggtttgccgaactgccccaaatggtactggtggccaactggcgatggttctggtgtttgaaacaagaaactggtgatgagggggagagggagaaagaaagagagagagagagggcctccggaggctgccggagggcagccaagctcactgtgctgctcccaaaatggcccacagctgctcgaaatggtccttaattgcactttaccaagcttatatatattttacacctgttctttttttctgtatggtatggtttgatactgttagtatggggatgcattgtaattttgaaatgttgcttctagatcagatatctggttgagttgtgcactatgatacaaaattatacagatttttgaccatacatggatttgtaccatgactttaaggccaagaagcagcaaatattttccaatatggttagtttagtacttcaatgcttgtaggagttggacattatcaattattttttaactgttttctgtaatacgagtattttgttctacatatcatgatgcaaaaccgagttaattagacttttgaatatggtaatagatgtcagaaaccaaggtttcaagtacgggtatcgaatctcgtattatttttctattacaattgtgcaatgtcagcacagcatgggttccgagttccgacgttatgtgccaaaaccgagcgcatcaaaaaaagtgaaaaattgtctgcatggatcagtatggttggcaaggtaccatcaatggaaagtggtacaaatcggtgtgggcagtacatactaatacgctgggttttggcatccagtcttcatattggtgctggcatcctgttttggcagtttttgaatccatgcaactgtttttttttttttttgcatctaaagggtcataaacacttatttagattttacacaaagttttcatcttggccgagatcttggtttgtattggtggtatcgaacacctgtcgatgttatatatgtaaaaatcaaggccctattatgtcggttgatataaactgataaaactcgagatatcggataatatgatataaatcatatcggtctgaaaatatcacccgagatattagaaaatctcaacgtccatcagttcttccaacttaccatattgacctagctaaatagagattttggttgatctcagtcttagtcgcttatctaggtaactgatatatgaagatttaaaaaccttgattttacacaagtgaaagttcctaggttgtttaaggtgcttagatggggtgaggcacatctgattcatctgaagccccgataacccctggtgaggcagggttgataaggcaatgtttaggcgtatgcataggccaagttgagaggtgttagggaaatcacttttctaatcttgattctcaagctccattcttcaaaattccttatttctcaacatgtctaatatctaatttttattggaggggcatttttgcccaatgcaacgcttaaaagcgaagggctaaaagaaaaaggaacccacctcctctttattcagctgggagctagggttttcaagcaagagggcaacggtggagcatgaggtaaagaagagggatagcaatatctaaacccttacagtttgcccttctttattactccacattgtccctgtttctcccatttaattggcaccaatctccattttattcttcccatgttattttatgtgctctctgtgtgtttgcatgtgtatgtgttagtttcatcaaatcaggaagcataagggggtttccttttctgttgtttctattttttctttgctcgatctgtctatttaattgctgtttcatttctcttcaattttctgcttcttaatttctttttatttttgaatgcagtgcacatgtttgatgtgccagaagctatcccccatgaaatgcatgtcaggcatcttgcactttaacctaattttgttacagcaccaatatgttatcaaatttaacatgatcatgaacagcattagaagtttgggttcaaatttagtgccgagaatctgggaatcaacatgggctgctaaggcgtttgttttttcttccttaattatttagtgaaccgaagtagtttatgttaggtagttatcataatagatatactgtttttgtttgcttggttcggttatagaagcaatctgatgtcttcaatacaagaaacttgtcaaatttcattatgatctaaaaatttttcatattgtttatgtatgattcatgaagtctactaactccatatgatagagaaaagaaatggtcagtttgatgtttatatgatacagattgtttcaaatagacaggtttttgaaattatgagcatcttccatggttcattttttctcaatccaatttcactgaaataattcttgtttgcagggcaaggtagatttcaaagatacagaaacatatgaatttttgttcaaggactattgggaaatcgtgaaggaccaggaaggattaacgttggttgatcttcatgctgctaatgctcttcttaaacgaggtcacaattgtaaaagtgaatcagattctgataagtttcctgaggaggagttgatgtctgaatgtgatgacttggatgatgattgtcataatgagatgtcaatcctcgatgatttaaaagtaaggcgtggtaaaatgaaaactccaataaaaaggtgtaggtcaaagagaaagtatattggttggggctcagaggagctcataggattcctttcatccattggcaaggatacagaggaacctcttacacaattggatgcttctgaaattgttaaggattatgtccaagcaaacaatcttttcaatcctgacaagaagaaaaataaggttgtagtgtgtgatgagaagctgtattctcttttcaggaaaaagaaagtgaaggttcataaaatctacagcttactggaaagtcatcttgctgcagatgatgatatggatgacgaatttttttttagctcggatgatgatgacaactcagttatcaggagaaagtggcaaaggacaaattctgattccaagattcgcaaatcagagccaaatcatttcaggcaaaaggttatggaacctcccaaaagctgctatgcttctgtagttgacaaaaatattaaatcagtctatctgaggaggtctttaatcctgaatcttctgaaagaccctgagatttttgaaaacaaagtcactggttgctttgtgagggttaaaaatgatcccaaagatttctactgtcgacctcaaaatctataccagcttgggcaagtgacaggtatctgcattcatgtgcatgcatttatgcttgatgctgtccctcttaagcatgtgctcctcctaggggaagcctaaacctcaaaatgggtacgtgccatatgttggcaccttctattatctgctagagagaaatatacaaacccctttgactttgcagtcaggggtaagagaaatattcaagtccaggtgaatatatgtctgccatgcacccatcttgagattagttttccttttcacagaatggagagccaagtgtacacaacacacatacatgtgtacatacatacattacattacattacatacatacagacatacatacatatatagatgtatatgtatgtgtatgtatgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacacacacacatatatagatatatatatatgtatgtgtatgtatgtatgtatgcacacacacacacacatatatatacatacttatatatataggttgaagaagagataatttctgttttcgtaccaggtattaagaaggttccacatgcatacaaggtaggagagacattgacagataccgtcctatgtgtttccaatatgtgtagggatatccaaataactatgttatcagatgatgattttgaggaggtatacccagtaagacttttgttacacacttgttaagcattgcatcatttcatacaatatcttatttcttaaaactcatcgtcaatgagtttaagtcaaaatatgcaattctctctgttctgaaacatatactgtagggttattagacaactctaatcttctcttttgccaggtgttgctttgatgatatttctaattttttaattcacatgcatataactcagcaccagtcttttgagattttatgcaagcacctcgcttaattcctattctgcatctctatgataggaagaatgtgaagatctctgtgagttggtgaagagaggactccttaaaaggcctacaattgtgagtttttccttcttagagctatttaatcttgtgataccgtatgcctaagcattgcttttgcatctctgtacctaataaacatggagaatcagtatttttcaacctacaacatgaaagagactcgtatactaaatactatcaatctatcatggttatcaacatacacttttatgtttttcttattttatttgataagttgtagtctaccagaatttattgacaatagaatatttattcttatttcctttcttctgcaatagtttttgtatgaaatgaagaaagtaataagtttctaggatggtcattttgtttcagtagctccatgaacagaagaaaagtgctctttcatttataagtttaggagacttccatccaggtggttgacttggctaacggagtcttttaaagtttaaacacagtttatatactagagcagtgtatattaagtatgttattattatctagaattgcagataacagtagttcaagagcaaaaaatggttgaaatgtggtgcaaattgctatggagggtaggcaacattattcaaatcaaggattgtgaaatcaactttcattggaagagaagggtaaacaagggtttggtctttgtttggtccagtgttatccagaagccattgttttaattattttcttttacaagaattgggctatggatgtagatatgtatagtagaatctctgtaatttggatgaggtggagatgctctcattctggatcatcaaaatcttggggctagtgacttgctaacaatgttgtatgtgttggcatgttgggtaaaatgaagcatgtttgcataaattggtaagaatagtaatgattatgttgaacttagtttgtggaagcatttggaacatgctttaaacataagtgtggaaagttgacttcaatgctttgttcactgtaatgaagcctgagaagagaaaatagaaggggcttatgggatttggctgggattcctaaattgaagtgatgagaccaaggaaaacatgtattgcagtggccgagggaaatgtaaatgctcgtggccttctatagcagccaataaggaagcaaaattcataaacaatgcaaactgaaagactttccttattatgactttctatttgaatataaccatttatacctttgcaactgtatgctgattaattttagttagggatatatttatcttaaatagagttttaatctgtttaagagtactatttttgagtctaacgaactaatttacggaaaagtgataagcatggtgaggttaatagtcttttagtcatttggactgttttgaagagtagctttaatttgtttatattaagatttatttcaaatttctaaagtccacaatgcttgttgttaagattcaactatcaaaatttaaatgctgccaacctttttaactttatattttatagtttgaatattggtcatatatcaagtactgatgtgtgaccttcttcttctctcgcttatgtctaacgtcccatatgttaaaggggttcggtatctctcacttttatcatactaccaccttttgcttctttaagacgtgaagatattaattcattaatatcatgctaaagttccttaaaggcctttctttttttttttttttttgggtaccttcatcgaggcttttattaggttctaaacattgcccatttttctttcacatgcaagtacaaattcctaaatattagtattttgtacttttattttgtttaaaggtgaaccttggcacaacagtaggttgcaccattgtgacctagagtttatgggtttgaaacatggcaaaagcctttctgcatgaggggttagggctgcatatatctgaccctcagaccctgcaatggcaggattctcgtgcattaaggcacccatttactttaattttgtttcatcttcatatgttctaactttagttcatttgactaacactttctgtttacaatatcattattttccactagagcataggggttttcagtatattcattaagatggctacttttaaattctgctcgctttttattaaagaatggtctaccgcaccattacattttgtagaaaaaaagatgttgttttagatgtgctaactttttggtagccatttggaaatgcagaaggatcagttctggtccatagaaagaaaggaaagaggattgattgcgattcttgatggaaaatgtcaaaaatgggatgtgatttttttctaatttaatgattaagacaatcaaaaaaaataaaaaaagaagaagaaaaaggagagtggaaccagatgcatccttgcatcaacaatatcaaatgtacatataccacaaaagagggatgaataatttgtccattagttgtattcttcaatcaccagtgtaaatatatgtgaatgtcaattttcttgcttcagatggcgaagtacatttacatttattgcacagtcatctaagaaaaggatcttgtttcacatgtcctttgcagtgattatttagtcacagaactttggtcatatatgttttcttcagtgtaatattatgtctggaaaaacaaactcaagataatcttatttgaaaactccattagttatatttacaaccttggtttctctttttctgctgaattgcatatttatctgtctttttatttttttctgagaaggcaaacttatcaaatttctttttagtgattacattgatgtctaaccaattttgatttttcttgctcttttggcaggcagaacttgagaaaaagatcagaattgtgcatgaggatattacaaatcatgtacataccttttgtttctttgatatgttagcaacattgtttcctgaatctgccttccattttggaatttgtgtcttcagaaattttatttgcgatgatcttcttttgttgctgtttttatactctgttctttcaaaagtaatcttgaagattgcaataattgcagcatgacatagtctcgtgacttcctaaaaattacatgtccctgtgtttgttttttgtaagaatgatagattgatgtgaacataagccaggaagctagttcccttgtttaatttgctgattattctatatgctaagtttctcttttactaatctagttgatttcttctcagtggattgatagagagattgtgaaattacaaaaactgattgatcaggcgaatgacaagggatggcgcagagaatatcctacaaaataagagctgaaaatacaaatgcttgtggacatgctataaaattcaacaagtccattcatctgctgatctagcacattatcatcttgtacatttcactggcttagttgatacgcttgaaattattttttcttgactctttggtacgctatttgactatattgaccgaagagagctgctctgtacgccagctgaaagatcacgccttctaaaggagattccacaggtcattgcagatacagaagaacaggttgaagtgaccactgatacattagtaaagtctcatggagaacataaaggttcactgtactctttgatttctgtttagcatttgttttggatatgttcttttttcggtcttgagagttttctgtttgtgttctgatcggttttttgctatattctagggaaaatttctttgagcctctgacagtgtggcccgtaaaaccacatctctttttctgctgtatgtgaattccaagtttaaggcactcttctttttataactataaccactcaaaataaaaaggaaaaaatagggtctcataaatgactaccaaagagtatataagtggtggttctaatgctgccagtttggtatgctggtaccatactattctgatgagaaaacagggcctgtgtaggtgcaggacactggttctcacctgattacctgaacgagtatgtactgactatactagtatgtacccaccatattggtctgtactgatacccaggatgtgttgggagttggtatgcattgattcctttttattcttgttgattctaattgtttcagtccataatgatcataccagtaccttaccattttggttaaaaccaacacgggcctggtactggtatttttaatcttaaaataaactaaattggtaatatagttgtttaaagtatggcacacaatcttgattgatcagattgtggcatatgctcatagtttgtcaataaaccatgttttgcatatgctcattgtttgtcaataaaccatgttttgcatatgcagggatctcttcatattgactctagtatggcatgagtaatgcatgtggccttagaaacatggaaacatgggttcatggagattcatgaatgaactcccatctgtagtctggttatagagtttaccatgtaatatatgagcagcttgcccctattaaagcaactgcacagcaagtttattggtgttacaagtcttgagggttaacaaggttgttttgagtagcaagttgatccgattgttgtcctactatattatgataggctttaaaccaaaccgtgaccctgcagaaggccgaatttggagtcttgaagggagtcatatcagtcaaaaactagtcatgatactttgaaattgagacttgaaggattcaaggttttcggcactttatagttttattgatggttaccctgaaaatttgaagcattgctggaaagagaagatgatacgacgccaaggtgtgagatgcgaaacatttcgtttaagatgctgaaaatatagggagaaatcccatttgtccagcttgctttcttaaacatcagtctttctctttctctgtccttgagcttcaatcatttatcatttgataacttctaattattttcttaagacatgcatttctttttcttatattaatgagaatcttatggaattcgaagttttggatgcacgtgttgatgtctgcatgtgtggttcctgtgatactctcatatcaactgttattatggttttgtcttaagtagctgttagtatgattggcaggtggaaatgtcgctattatggaagtcccgccagaggaagctaaaggtttgttctccttgtcttgtttctttcttggtccattacagtttatctaaatctttagtttattgaattaaacatgggatggagtagattggagactttgatgtccagattttatataaaaagctcaaatctagattaaaatcccatggaaattgcattgcttgggtatctaaacatgataaaatggctgtcaggattggcgaagcaactagcctgtggaacttagaaagaaattcaatcaatcttgatggaactgatttcatcaaagatgcatatgggattgtctgaagaaacttattttattccataatgaataaattgccttttgacttctaggtgttgcatttcgatctaacagaaacatgttttgcaatttttgttcttcacatcttgattgcaatacatgctgcctctcagaagaaaaaaaagcatgaagaagaaatgaggaaccctttgattgcttaaaggcacaacattatagacagaagaatgcagtatgagagagaggaaaaaatattgaactggtcaattcttatgcggtgaaaaacattcaatcgtataagttagaattttaattttaagccatgtccaaaatcttaaaaaaaaattatccattttgttacattacatcgcatagcacccttaaaatcagggttcattgaactgtaccggcggctaatcagtgtggttcggatgtttgattcaaaatgttggcaaaaacggagtgggggagaaggaaagagaggaagagagagagagaggaggagagggaaggaaagggaaaggccggtggtggtccgccgacgctgctggggctccaaggtcctctatgagatgcgaaaagagagagaaatgagagggagaggggaagggagagaagaggagagatgggaaggtggcggggaggccgtcggacagtccaaaacaaccccgcggctgtcgcgggctgtttgtcgtttagtggccacagcatccctccagcggcctcttggttgccttcccctctctcatcttctctccctttccctctctctctttatatctctctgctttcattttctctcatggaggactgcggagctcgagaggactcggtggtcttccgttggcctctgcagccctccggtggccaccgccgatgcctctaccggtctcccttttctttcctccctctccctccctctgcctttctctctttttctctcttttctttcctagttcatccctcgtttcaatgttggttcgggcccggtatggtccagtatgggggcataccgactcgtacagccagccagccggtatgaggtccggttctgagtcggcaatccttgcttaaaacttttggagtcttggtaatgattttccaaaaagaaaaaaatgcatgtgttttaaactgttgtattagcatagcagggaatgtattattctcatgtgaaaatgctgctgaagaaagatctgaagtatgcctatatgtgtactttaatttgctttgaattatttgtaagtgacaaatgctagctatgcaagatgtaattattattttccatagtttgtttcaagctgctgctcttgttttcctttgtaagctttctccgatcttaacagtttggattttttctttctatattttaataagctcaccctaaattacattagggtgcttagtcaccagattgtctggtggtgaatgtctgttttaaggttcggaatctcagtatcggaccccgtagtagtgccacattggtatagtgttggtatgccaatatagggttggttcagcatatggatgctcgatatgttgcacgtactgagtatcagtttggcattggtatggcacagtatgcctgtatggggtggtaggtgccggtactgcgaactttgtttcttagctcataaatcaccttttgtacagtcttcttagatagtccacgtatactttgcacttgtaaacattttgagattttctgcatcatcttgagaatgacacttaactattcgctgaccattcttggttttaaactgctaccgatgagtaatcctgaaatatagatgttcttgttggtgggattggaaaaagataaaatagtgaaggtcccggacgttcctcttcctttcttgttttccctttatttcctctggtgataacttggctgcagattttcttgactactgatataggagagttttttttttttcattctttttctcgactttttcctgaacatgtcatctgcaagtcctctctatctagcttcatccatcatctagtcaattattgattcatcattcaattttcaacttgcttttatgttcccatatattcttttctttgtttccttctttagccctgatcatttattatttaagggtttctgcattcaaacacatttctttttacacccctaaactaagaaagctttttgtggtccaaattttgattatattttcttctggcatttttttttgttctataatattttgtttttattttttatttttttgaaaagataacttggtttatcaaatagacataatcagtggattttggttacaattagaaggtctgcatgtggctactgtagaattcccagcacagggagctaaacatctggaaacttctcagagaaacttgagagtcttccttgatacctttggagatgaggggaaagttctttttcctgtccttttcttagttccaagatagttgaaactattgcttttgaatcaggagaatactttgttcacttcctgtctgaacacatccttcattttttttatttctttaggtttacctgtctttcactcatccattgcccatatttcaacttattaagtagtagtcctttcatttctttctctatttttatctttgtggatctgttaagcatttctgattgctttctttcctctgtttcctcaaaaaatatttcttaataatagtataaattttacatatagttatttagtgttgttgttattatatttcttttttttgggtaatattgtagttattgatctatgatataagtagcttgtttatcaaattttcatattcaattgattttggcttgaaaacttttattaccagttatgttactcgtgaggaattgccattaggataaacaaaaggttcatgaaaataaacttgtttctttaatttttaagatgttatcatgtacattatggttctgttatatgaactaaaaattggttgtacttggctttgcaaatgcaaggttaaaatgtaaataaaacttcaatctaggtgtatataccatggttctatttttgcaactgcatggcttgggcatcaactctgaggatcatatgcctgctagagttgaagcagtcaggcttgccaccttagatggccatctggacttattaggacattttttatcaaagaatgcatatgccatggtctgcatatcttgcgtaaaatcttatttgcttatctctatctcctagatgttaagtttccatccaatgctattgtctaactctgctttggtttttttatcttgatccattgattgcaatatatgctgcttatagaagataaatgtcatcatcatccaaaataaataaataaataaataaagagagaagttgcagatatttaaacttctgctctggtgtagcagggaatggagctgattcgcatcagaatgctttggaccgacaacctgaaggtttgcttgtttatatatttttaaataacttcaattcgaaacatttgtaactagcataatgatcttggatatgtttaactgtaaaacccttctagaagcagaacctatttttttaagtacttgttgtcgtcgtcattgctgctactttgtaagctgttttgggctttcagttcacattttgcttctgatttagcttcattaaacttttttttatgtcttttggatcatacttacattcacttttgcctattcacccgattgtgtggtagccttttgtcttataaatctttcatattcttttgttatctagtgttgttagagaatcattttattaatatcctcataaactttgttttttttttttaattgtatgcttcatcttgattcttgagaatggcatttaactgttgcattgccactttttaaacctttaagacctctggtgacgtttgatcattaaatgtagttgccagtagatgtgattgagaaagataaacttctgaaggttcagacagtacaatgtggcgcataaccttttgattcaagattttaaaactattccttttgatttaggagaagacctcgtcattgctcatctaaacttctctagaagcacgtgaagctttctgtcagcttttaagctaatttcatttgtcatctccatattacttcaatcattttttttttttaattttgctgcttaaacatggcatgccattagaaaagtttccatgcttcctagtcaatatcccattaatctagttaacaattaggaacttagcttgagttttatgcctccaactactgagccatgttgtaggtgtctggattcagtctaagtgtcctttatccatttcttcctgttattccaatgctatagcaagttttccagtttctttcttataattttcatccatgtaaccttgaatcttcttctgctctttttagatccttaaacacagatttgatgacctttccttaggtggcctcggatccttatgcacaggttcaaaccacgttcgattggttcttcattactttagcctcaatttcaccatagtatggtttctcttggtctcatgcagggtttcaggtgctggtccatgttgggccagttttggcacgtggtactgggttgatactagcacagaatgggtgttttggcacagcactgcatgtatgttagcatggcacaaaatgttccttgccggcctttggccagaacgcttcatgccaccaatacttaaatccttcatattatgtttgttgggccctcagtttcagttttttacggttccattacattttatatgtgccgtcctataggctttttacaccttatctgttaagattcttgttcatagttccaatttcacatttaaccttgtcgtcttatcatcaagcaactttacatcacccacaaattagatacaccaaagcacatcttctagataagttcattgtaagagattcaggttagctttggcccttcttgcaaacacaacatcaccaattcacctgctactgagagctacttctctatgtactctatcctgtgctttgttgaagttgatagtaaccattcatggaatccttctctattcccttcatcttttcattctatttcttaaagcaagattagtctttgtgctgcccttcttggtctaaaatgacagttgattctattagattattgccttctaaatattcattctatcacctgttcccactgcttaaatacatgtgtgtaatacttgtccagacatttttcctcttttcagcttgggcattgcctctcaaggtcagacagttataagattggagaagcaatcagactgtttgacctggttaactactttttcttttataggccaatgttaattaaagaacacccttgtattgtatgcagaactcttataatcctaattctttaatagatgaccatatatttgccaactcttaagcttccatctatggtaaccacaccttggattattatgtctcactctctcggttgctatatatgctactataaagaggccaaacagcttgaagaaaacttgtctgaatttgcactggtgtagcagggaatatagctgctttccatgaagatgctgcagaagaaaaatctgaaggtgtgccaatttatttttttatttcatcattgtataaaataattttatgtaattattcctaattaggatggatataatcattgcttgcagtaaccttttattttattgtgttgttcactctgaattaatttttattcatgggcatgatggatcacaagtacattcttatttgcttccagtcgctagatgatcttgtaataatgctggatttcaaaggaagcccttcatgttctttttctatgtactgtacctagagggctaatttattttgttaatttcctcttaacatatttatttcatctagagaatgacatttaacttggtgctgctgcatttatggtttttagtgatggccagtccaagaatgtagttcccaattggtatagtgggaagaatacaaaatgttgaagtttctgaaaataaagttccccttctgcactgataataatgtacaatcttttggttcaagatttttgaaatagttgtttctgaattctgatcaaggagaaaacttcatcactttccctcaacttcctgaaaagaaatcctttacatgctcttgccattctcttaccattaatttttcagcttgcttctgggaaaactaatctttctccctctttgcttttgtccatgtcattcaaattttttgcttttttagagcacccttttttgtttggctttccttgtattgaaatcttcaaattagcatctctttttctggtgacattcttgtgatattttctgatttctattcttgttttactcatcaacttatttatggatttttaatgtggttgattgtaatatgatgggtaggtgcacctgttgctgatgcggaagtcccgacagaggaagttaaaggtttaggttgttaacctatactagatcattctttttagccacttatgatatatttctgtaacatcatgaacctaaagcggttgaaatatcatatagccagaagtggattaaatttctactacatgactatcatatgaatctaatgatgaatcacttaattagtgcatctcgtttcaagaataagtcactatgatgattagatatgaaatatggtgaggaatgtaacaaaatactaatatgttgatatgcaaatcttgaaaaaaaaaggcaacatacaatattgccatatacaagattgccgagtctctcctcaggataagttcgatgtcatatttctcttttcttttcttctctttttaatagaatattttctttgttgcaacaacaataatgaactgcgatccaaagaggctggcggatataaaaaagagaaagtaagattcagccaattaatctattgctaaggggagtaaagatgcagcaggtttgaaaccagctgcttcagccccccgaacttctctggctccgacctcgataagcattcggtcgtttgctgcccctgctgaggagctgacgtcgtagacgtcacatcggcagagcatcgaggtggcctgtccacgcaccaaggaggctagtgcacgcccacgactaagttcttcgcctgtgcctcagacttcgagaagaccagcttgatcgacagaacaacgaccgaagctcccagaggcggctccaccttcaattgaaattgtggatgtggtctagatgtccctctttgagacaccgcatctcggcagagacttgttgattgtggttttgcctcagagggacttggatgctcgaaggagggacttctccatcgagcaattactgaatcatggctacgtcggtctggtggacataagtctttttctatccgtacttttatttgcatcggtttttatcgatttcactgtttttcctttttcagttagccttggaaatcaagttgctccatgagcacttgatatggttccatgaatataagaagtccatggaagaagggctcaaggccgagcaagacagcaagaaagtgactgaggaaaatgtggcgaaagaggccaagaccgctgagggtttgaagaaacaactctaggataagatggcttcaatataggagaaaagtcaggctttgttggatcaatagcgccagatcaacgactatgagaagaaatttgaagatccttgtgctgaagtaaagatggattttcaagctggaatccaagctgaaggaggctgaacagactatagaaaagcgtgataagagccttcttgtatttcaatgatgggttgaaagagagaaaaagctgtgatggcggtcgagaactttaaggcatcggaggcgtttcaggacaaagtcattgaagcctctgaaggtgcctttttctatggcttcaagatttgcaaagacttagttaggaagttcttttctgaccttaatatcagtaagctgacccccgaaatagctttgaatgcatcaactgaggcggcttccgaatctgccactgaggtagctccttcagccacagataaagttactgttgctgagatagctcctcagtctgttgtcgaagtggctcctcaaccgctgatcgaagtggcccctcaagtagctatcgaggtccctgcggttgagattatttcgatcgagtcttctttagctgaagcttccaaggatccagcccctccttccaacggtcttcaggctaacgcctaaattttgtattttctctttccttttgtgaacttgtgtatcagcctgatgtgggctttttttaatacacttcatattaatgaaaaactttttccaagtacatgtgttcttttttcttctttttttttatccgatctcacctaacccgatcttggtttaattgtcatatataggacttcaaaaattttcaagttatatccatgatgaatattatttgactttggttgggtcaactatgaagccgatgtggcttagtggaataagcaaatatcaaaacataagacggtctaactttaggaattaaaatggttaatagtaaatcaatatcaacaaaccgtatatttataatagaggtttgagaagtacctctcatccgatgttgaaatgtgtagttcaggtcttttttgaatcagatgtgatttcaacatctgttgttccatcttttttcctttcatgggcatgtcgtctaggaatttaagtcagaacttaagtctctttgaatggatatccatgaagtacaatctgtagatcaatcataatctataagatgcccatgaggtttaacccagagatcggatatcccacgttagatatttgtgaggttcaatccggagatcagatgtctcacattagatatttgtgagatccaatccggagatcgcgtgtctcacgttaagttgtcctagtttggcattctcatagcccgagttcaactttttctgacctcgtttggacaagcttagttgtttttttatcctcatttggtcggactatatgaccttatttggacaattattttatatcatccatgtttgatcggtttttactgatctcgtttagatgaagaattgttcttcaggatgctctgatttgaacgttagaattcagcctcattttggcaaagattgaaggcttcattgaagagtcattgataatacaatttacagcattccaactacgtggaataattgagctatccaaattctcaattctatatgctcccaagcggattacttcggtaacttggtagggtccttcccaattgggagtacgctttccttgttttgtaggttttgaaacttcagttcggcggagaacaacatcttctttatgaaaaagctttgattttatctgagcattgtaatatctggccaccctttgtttataagttgccatgcagatccgagctttttctctaatttctttaagcaaatctaggttggttctcagccgatctggattacttttctcgtggaatttctccactctagttgatgataggctaatctcaacagaaattacaacttctaccccaaaagtgagtttgaaaggtgtttcttttgttggccctcatggtgtggttctgtaagcctagagaatactatatagttcatctgtccaaagtccttttgctttgataagtcttatttttaaaccttgaagaatggtccgattggtgactcgctttttcgtttgattgcgggtatcccacagaggtaatcctatggtctatgtcaagctcggagcagaattcttttaacttcggattgtcaaattatcgtccattatcagtgataatgatttgaggcaaatcaaagtggcagacaattgattttcagatgaagtctcgcatcttcttttcagtgatttgagccaaaggctctgcttctatccatttgatgaaataatcaatagttaccatcaagaattttctatcctgttgccattggaaaaggtccaagaacatccattccttatatagccaaaggctaaggtgcagtaacgggaatgagttcgactgtaggccgatgttgaatattggcatatctatagcattgatcatatttattaataaaattagctgcatctttttggattgttggctagtaatagccttgtcggatgactttgtatgccagtgacctacccctcaagtgattaccataaattccttcatggatttttcgaagagcatagttagcttttgatagccgtaaacaccaaagtagaaaaaacgaatatggtgtcttatataattgatctccctataagatataccatggagcttgtctcttaattctccttgcttcaataggatctgtcggtagaacttctttggtaatataatcaatcagtggatcaatctagctagtcttatagctaatctgcatgattggaagagtttcgatgctggattttttgaggtagtagataagaatttttagtttgggaaaacctgatgtgcaagatgggataaagcatcagctcgggtattttttgatcttgaaatttgtataacctctaggtcttcgaagtcttttgataatacttttatatgctgtaaatattgggacattataaaatctttagcttcaaattgatctcgtacctatccgacgataagttgcaagttggtaaaaactttgagtcctttgatttcaagttctttcatcattttgagtctgacagttaaggcttcatactcagcaccattgtttgaagcacggtattctgtaccggcctgaattggccgatacatcctgtatcataccattccaatggggaatcggttcgatttagactgatttttcaaaaaataggctgaactggaccaaaccagtgggttcggtatggtatcagcccgaaccactggataccggatggtttggtccggtatggtgtggtacggtatcggttcggtccgatttggtttgactttttttttggccattgaattggattttttttgaattttttattgtcggtacagttcgataaagtacgatacggtatggtatgatatcggttggcaatcgatatgggttttggtatcaagtccgcaaatcttggtttgaagtattgaaattgaatcttaggacattcagggacaataccttcaagattagctaaaattaaaccagctccgctctctttgaaatttgaggctctatcaacatataatacccaataagaatctttaatgatcttttttggactttctgaggttggctcttcatcagggatgatacattccacaatgaagtcagctaatatttgagcttttagtgagggtcgagatcgataatagatgtcaaatttactaagttcaatagcccatatgaccacccaatctgaggtatcaagtcgttgcggaaccgactttagaggttgatcatttaagacgacgattgagtgggcttggaaataaggccgaagtcattggccgatgtaataagagcattgatcatcttttctattttggtatatcgagtttcggcatcttgcagcaatttgctagtataatagatcggtctgtgttcctgcattatctcggactacaattgaactaacagcattaggtgaaatagataaatacatatataattcctcaacttcaactggtttggacaataattggggtgaatcgagatatttcttaaggtcattaaaggcattcaacattctttcgactagctaagtctttaatgtctcaatattttgaagaaagagagatatttcttagttgatctaggaatgaatcgaccgagtgatgccatccattcgataagtcattgtaccttttttattatacttggatactttatttcaagtaatgctcggattttctcgggattagcttctattcctcattgggtcataagaaaatatcaaaaattttctcgatgttacttggaaagctcatttgttaggatttagtttcatttgatgctttcaaagttctccaaatgcttcttctagatcgattatatgccgatctccttcagtgcttttttactaacatgtcgtcaacataaacttttatattacgatcgatctgctatttgaagattttgttgatcagatgctggtacgtagcacttatgtttttaagatcaaaaggcatcattttataataatacaaacctctttcgataacaaagatcgtatttttttatcttctggtgccattttgatctgattatagtcaaaaaatgcatccataaaactcagtaatgtgtctcgaagtagcatcaataaactgatctgttctggggagggaaattatcttttgggcaagttttattaagatcggtgtaatcaatacaaatcctccagttgtcatttgcatttttgaccataacgacattggctatctacttcggatattgggcttctttaatgaatcttgctttcaaaagtttatcgatctcttcatctattgctttgtctttctcaggcgaaatactttttcttttgttggactagtcggtgctccgaatcaacattcaatttatctacaataacattggcagaaattccagtcatgtctgaggctaatcaagcaaagatatcgatatttgtctgaagaaaagatatcggttatttttttaaatcagtccttaattgagatccgatttggatagtcttctctggatgttcattcagtagaatagcaacaagttgttcagctggttcatctcgatttttgccgatatctgtgtcatccttttgatccagcatttcaattggtaaggcttttactggtttcttcatcttggtagatatcaaaaaatattgtcttgcaagcatttggtctacatgcaattcttcaactccatttttcatcgaaaataaaactaacagttgataggtggagattactgctttaagtgcattgagtttaggtcggccaagaatggcattgtaagttgatgatatcttgacaaccagaaagatgagctccacagtagactgttgaggttcttgtattgtggttataggcaaagtgatttctccttcagcagctacgggattttcagagaatccgactagcgggatgtcgacttatttcagcctaacatatgtatttttggaaatgcatcatagaacaatacattagtaaagtttcaattatctactaatatctttcttacatcattttttgttattatcatagaaatgacaatagcattattatgaggagtttggacttcttgaacatcagtatcagaaaaaaaaataacattgtctatatgctgcctctttggaggactttcagctgtcctctgaactccactaaggtctgtgatcatgctaataaccccagcagtaggccgattgtgttcagcatcatcattgggtttctggcactgttcagcaacctggcttgtccgatctcggacatgttgagataactttggcggatcaggacttcaatctcgtccttaagctgtcggcattcttcagtgtcatggccatggtcttgatggaagtggcaatacttttatctctcttcgttggtggagccttcatgagattaggccgatgaagatatccttgatccttgatttcttcagaatctgagcacgagcagacaaaggggtataagtgtcaaaatgccgaggtgggcttcttgacctcgaattcttctaaggtcggctagaaccattctctggccgatctctacgatcctcttcttggggccattttttctcattctcctctttcttcgcttgtcgagttatactttcttcctcagcctgagcatacttttggattcgggttagcatttgatcgtaggtgtccgaaacaaggttttaaatctcgtgggatgggggtgttccagaatctccatggaatggggtgcctcgttgtccgatcccatctcaacagccatttcgatcatgcattccgatagatatcctccatctctctctccttttctcctctttctttttttctttctttttcttttgctttcctttcttttcctttttttcttttcttttggtcatttctttttttctttttcttttcttctctctttcctttcttcctttctttttctgctcccttcttttatttctttcatttttctttttcttctttccttccatctttcgttcttttttttctctttcttcttcttttcctacatagatgagtttcagagtttcgaccccgttccggttccgttttcttatacgaacatgtcgagacggccgagacgccccctgtcccgtcgggatgtaaaattttggtttgaaaaattcttgttaagggagaagatcaggcgattacctcggaatctttattttaagacagctatcgcaacagactcattgaaatttttgacttcaagcatgacgtattgaagtgcactgtatactcacagagggactcaccctcctattgcttaatagaaaaaaagattatttgtattcttcagatgaagtcagttattagcgaaataagtgacaaacagtttggctaactgctcaaagaaagaaatagaccccggttggagtccagaaaatcgtatccttgcagattttttgagtaatggggaaagtgatgcaaagcaaggcatcagatgcctcttgtagcctcatagcagctctatatcctttaagatgatctagaagattagtagaaccatcaaatgattctaccattggcatcttgaatggggaaggtataacgttcattcaaaatttcttgagaaaaaagggatcgtaggtcaaaatcttgcttatcttgggaatgattcccaagttatacttccatcagccgtttttcaagatcttgaattttcatttcaagacctctccagcgtggtttcccactatcaggaatagatttcccttcaaaagattggtcaatttgagtagggtgattatcaggatggggatcttgatggattggctgatgattgtgttgggacagaactttttgaggaattgcctctcattgctgttttatggtacattggagttgttgtacggcaacagtgagagcctgcacttgttgaattaaaagagtgattgctgtggatcgaccataactgaaggttgaatagcttctggtccgcctcttggagaagatggtgaaggcagagaattattgtgctttctaatttaccatttttcacaatcttttgggcaagcctttcctttagcgcaaacttgttgctgcaaggcttcaaaggaagaacagtgaggttggtcaagaatccagctggagtgctgaagaggatcaagttgacgaagttcgtagatgatcctacaatagaagtcctaaaaccagtgcggtaccctctggtttaggacccttcgatgcttaagtcagcagggaccttgagaacagatagtataaaaatggaaaatagaaaaaaatagggtagagagagtagaaaggaatagagagagctcagattcccttcagtgggggagagaattcaacagagttttgactctgtgagttctgacttacctctggagggatccctgcttccttttatataggggaggttacttagctgttaagtcatggagagagtttgttaggtcgttagtaactgcttgagtcggagaatctgttggttaggccgttagttgttataacagaatggtcagctataaagagatcgtgggttgttattcacctacgtggagtatagctgtagcacagttggagagtagctgatttagaatatatttgatcttgaagagatcggtaaaggccaatgtccctgatagcaggtcggtagctgactcggtcaaccacaatacaagattgatagacacctcgggctggttcagattgacataaaactgatcagatcggcaacataccaattcttcctagtacgaccagatggtctgaggttactttatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaagcaaaacatgttaataaaatggcgtagcctgtactttatacaatttatcaacttccacaaactcatcatttagtcagcattgaaatcaataaaccttctacactttaatgtcaatatcacaaaatccaaaatcatccattcattgaagatttacactataaaaggaaagaaaagcttccccctctttctgggaggtatcacggaagtacattgagtgtatctgtgaagtatatggagctttttttaaaaaaataaaaataaaaatatgcttaacttaactattggcatgtattcttgaagcattggacaagtattgatttctgacatggacatggcatgcaatgtgaagttgctttgtagatggttagaggtgtagtcagaatggcaaacttagacagctatccaatcttgctaggacagattggttaaagaatatgttgagattcattgagcatggagtgaataaaatcttagtgtaacctattccattttatgactttccttcgttttgcttgtggttgggtttccatgtaatctgaatggcatgcttttagttattagatttcaatctcttgattgaactacatgctgcctaaaagaaaataaaagcatgatttttttaatcttcatgttagtatctctaaaagaagtagaattttatggtttttaaactatggcttggatgttaacagataatgaagctgccttgcatgaaaattctgtggaaggaagacttgaaggtttgctattccttaagagttattttttccctaagttcaatttagaatcagtgtaacttagttcaaggagatgtttaatatggttcttcattgtagtattttgttttatggtgttgcttcatcttttcattgtaaaatgcctaaggcctttgatttggactttcctatattttaattatgctcattctaacttcattgaatttattattcagttgttgttgtgtcttagttatatacacttatgtcatcaggatttaatgagcttgacattgtaagttgctgttcttgtgtagctaatgttctctcatcagttatctagtgttctcaaaagatacagcttattgatttccacttaatatacatcaatgaactctttttatatcttttgagagagaaatttaactttgcattgttgctttttgagcatctgctgatggttaatcctaagatttagttttttattggtgggatgggaagaagattaattcttagagattctagaagcttattatttttttcttgcttcttataatgcatggttgttgcttcttggcatctttttttttttaatcccaacttttttctgggcacatctttcattttttgactccttttttaagccaggtttgctcatcattcacttatttgatttttattgtctttatttatttatttatttatttatgatatactcaaacaggagtcatcaagctaaacttgttcctttttctggttgaaatggattaaataatttttttcacatagatgttttgaactgtcataggtgtttgaatctgcccttgtagatgtctgctcaaccatttagcttagttaataccagtattccatgttccggtctaagaatcagttagtataaggatttctcctttgaatcaaatgaacctattgccgctagtcttttgacctaggtcagctcagttggaaaagggtgacggttgttgttgtgtagcaacggcagaacctacaaaataagtctctgattggagttggcttcgatggggaccctttgatgctcaagtcagaaaaatcagaaatagatgggaaggagtgagcaagggagagttgagagcatatgtgggaggtctcctgtgggcctttatttataggtagaggctgaggtgttgtgaggaggaaggagaatcatgccgttattccttattgggtgtgatacattcattatgtcctaccttatctgatgagatatgtttgttaccctcttgccttatctgcttgtggtagattgttgtcggtaatcatgggattttccggcccatgtaattgaggtagcagttcaaaagtaaaacttactaggaatgccgacttggatcaattgggaaagtaccttggatcagtgaccaaaggtcagccacatttgaggcatccatacaccgattgaatcgaggtgaaattttcctccccatatcagatgcccccccaaatctcgagtctgggctaaaattcggttggatgaagagagtagattggttcacttggctctgtgagcgactcgtgttacgtcgaaactaatcggtatgaagcatcatgtcttcgccctgtaccagatgaagtgtcacatctcttgattggctatccgtgggaggtcagtccggccaatcagagagtgacaggtgttaaccatctaacggggctagccaaaccaatgctccatctgagctatctgatccctttcattttcacatttactgtttctttgctgttggctttgaggtggcgagggatttttgacaagggcttgggactccttccgacggcactctggcatccttctcggtaactggtcctaggtcaacttcggctcggcattgtttccgatcctccctaatccttcactttttgttcctctatttgccttctttttgggccttttccctctcttctttttttttctttgtttcttcatttggtatctcaggatgagcggtgaggcaggctcggctgggagttggtcgtctgatcaatgcccacctcgaagccccaaagccaccttgtccttggaatacagccccacgagatccaaggctaggcatcaggatgaagaggagacatttattcccagatattttgagtcggtactaggtgcagacgacctaaaactaatccgagctcagttttgggttcatttgagtaccaattggaagctccaggtccgaatggtcagagctgtgaccctcgttcaggttggctcggactttcctgagccgacgagctggcctaagactcccacttcatccttttttggttcgtcttttttgtttccttgatatgtcgctaggttcagtaatgccgaactcttggtgatttatttgcaactttatagccgcatgttttcttactgaggttaaaccgaccatcactctagttagggcatgcttaactttcaagaggcacacttgcgtgggtgactagtgatatgtctcacctcaaagaggggttcgccagctccgaggtgctccttcctcagtttacaattggaaggagcggttccttttcttctgtttcattcggggaggattggggctttgccccatggggacctaggaggtccgtacttcgggacccggccttaggagatgatgaggaccaagatttcaagattctgacccgttttaagatcccaccagttaaggagttgcttatcgagaagacactttaacatcgggttaagctaggctgactcattaggtgactcaatcttccccgctttctctttcctttcttctttgcctctttttttagaccaactttggttcgatgcagaaataaggttggagttggacaaagtcagaaaggtggcacaaaagaggaagaaggctttgggtgccaccatggctcaatcgaagcgcccgcgtgctgaagcttttgagggtcgatctggcccgattccggcacagggctgtccggccgtagggagctcatttgcttatactgacatggtcctcgcttatctggttgggtccctccactgagggcccgacattgcttcgatcttcatcccctgccccccgagaagggggcctttggagtcatctccttgccttggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcctggagttatgccggctgaaggtccatgagtgcttcctcgagctggacctctctttcttggacgaggacaacgacgtccttattgaagccccgaccccgagaccgccaccgtcgatgctgccactactctagctgctgaggatgctccctttcgagccgaggatgccactactcccgaggcttagaattgcctcgttttgtctttttattttgttttgtaatttggattggccaatcttttgtaccagagtaatattaatggaatgcattttcattcaaaccttgttgtatgatgagctgacttgttagtagaaagattcttaagttctaatccttgggatgaattgtcgaatttgcaagtcgaactgacctattaatctttagtagaaggaaatttccaagttttgatcctcagaaagaatcgttggtttagatagcttggaggttaccttagctgaagtgagggaggtttgggatccttactcgggcaattcgtaggtcaatgagatcgtggcatagccttcacattggttggacatcccaaaacggacctaaagcttgaagattaggtcgtcagattcgaattgtccaaactttcctttttggggttgaccattgttggcaaaatttaaggccttcagcttggctcgacttgggtcatagctccaagcttattgaaggggttctccgttcaacttttcgaggcattcagcttggatcattgagactatggtattccaaaccagccggtacatcccgtaccaaaccataccaatggggagctggtccgatttagactgggtttttgaaaaatgggctgaacaagattgaaccgatcggttcagtacggtattggcccgaaccgtccgatgtcatgcggtttgatccaattcggtatggttcgaagctggtttgattcggttcggtctagtttttttttagtgctggtggatgggatttttttgaattttttattattgatgtggtatgatatagtccggtatggtacgataccatactgatcggcaatcgatataggttttggtatcaagtccacgaactttaatagagacgaaggacagctttaagtcaagttggcattggtgatgtccaggacttctgaggttcccattgtggtttatccttcctcgttcattgggcggttaagtgttttgctttgctcgtcttaggcttgtggattgagttggctttgccgatatatggagcttccgaggatcctcttaaggggttatccatcgcttctcaaatgattaagatttttagctccgccatcagggataaggggctattcgagggtcctcttatgggattatttcttgcttctaggttgtgcagggtctttagctcgaatcatcacggataaggttttggagcttccaagggtcctcttatgaggtttttcctcgcttctcgaatgactaaggctttcagcttagcttgtcttaggggtggggttatccgagggttcttttatggagttatccctcgctttttggtcacctgaggtcttcggcttaagtcgtcatggataagattttggagcttccaaggatccttttatggggttatgcctcactttttgaacgatcaagatttttagctcagctcatctaaggataaggggttatctgagggtccttttatggggttacccttggcattttggttgctcaggatcttcgacccaaatcatggatgagatttagaaaatgaatttatcttgttaagcttgttaatgaaagaaatttacttcttattgaagaaaatggccattacattattgataatatatccataggtttttcgaattccatgatcgacgtaatggggttccatggagttgctttaagtgataagttccgaccatgatgaccttatccacttgatagggtcctttccaattgggggatagcttcccttggtcatctggctgatgtaccttggcttggtgcagcaccaaattgtcgattctgaacatttttcttttgacctgggaattatagaattgagccaccttgcattggtatgttgtcatcctcactctggcttgttcttggatttctttgagcagaaccaaatttgcttgtagttatttcaagttactttgctcgtcaaagttctctacccaaggtgatgggatatcgatttcgataggaatcacaactttcatcttgaaggcgaggttgaagggagtttcgtcagtagaaattcattggatagttcgataggtccagagtatgtgatgaagctcatccgctcaagatccattggcccgatccaaccttgtctttaggccttgcaaaagagttcagttggttaactcggcctccctattagcttgaggatgacctatcgaggttagacgatgggtgatgcccagctctttgcaaaatttggcaaataaagcattgctgaattgtcggtcgttgtctgtgatcagtacttagtaaatgccgaaccgacatatggacttccagacgcgtcgcttactctggcttcggtaatgtgagctaatggttcggtctcaacacatttggtgaagtagttgatggcgaccaatagaaatttctgttggctcgacgcttggaggaatggctcgaggatatccatcccccaatgtgcgaagggccaaggtgctccaatagaggtcagtggcacggtaggtcattgttgaatattggctttctactgacttggtcacatcttcttactaactcggctacatcatgttgtaaggtcgactagtaatacccctctcgaagtatctcgtaggccatggttctgcccttagggcctagatgattttcacatatctcttcatgtacttttcttaatgcatagtcggctccagatggacacaggcacttgagaaaaggtaagaagaacaatcttttttatagcttgtcctcgtagaggacacaatgtggtgtttgatgtcttatcttctaaggttcttttaggccagtcgagagcatcccatctttgaggtagtggactaggggatcgatcagctcagtttggcatcgacctgcagcatcgaagtgggctcctcgatgctaggcctctccaagacttcaaaagaggattccttgtgtgggcaaccagtgcagaggctgcaagcttcaacagtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagggtggtgtcggattgcggagtaggggattgtcttctttcttggttggggtttttgagttggctaagccaactttgcttctcccattacgggttatgcagaggagcctaaggtggtgttagctaaggcgccttttgaggtgctgtgttggcctgctgcatcacttgaactgtcgcagcaagcatctgcacttgttggacaagcagattaaactagtcaggggccaccccaccgtcgattgggaggatggagacggtgcttccgattgttgcattgatgtttgagcattggtggaaacctcgatcgatcttgaggtagtggcattggaacggcacgacgaagttcttttgcatggtgccatgccgataggatgcttgctccttgtgagtgggcttggcccttcctctggtgccaatatgttgctgctggttttttgatttggatcggcttggttggaaaagggcggcagatgctgtagcgtagtgacagcaaaatctgtaaaataagttcctaatcggagttggctccggcgaggatccttcaacactcaaatcagaaaaatcgggaataaaggagaataagtgagcgagggagagttgagagcatacctgaggaaaggttccctataggcctctatttataggcagaggttgaggtaccgtgaggaggaaggagaatcaggctattattctttaccttatcgggcacgatatgtttgttatctcctgctttatttggtgagatatgtttgttatctcctgtcttatttactcgtggcaggttgttgctgataatcacgggattctccagcctgcgcaatttagatagcagttcaaaagcaaaacttattaagaatgccggctcgggttggttgggaagcaccttggatcggtcaagacttaaggtcagccatgtctgaggcatccatacaccggctaaactgaggtgaaattttcctcccagtatcagaaccctatgtgggtgaaacaattgcactgggcaacttggtgtgtttgcactaagaagaccatgctagagtcttagcaactgcatattggtagctcaggcacgagataaaggagacattttggcctgtcgtgtgggagttctgttctacattttgtgtaaaagtttactacttcatgtgtctctatatgattttgatggttgggcattggaactttgggaaggaaacaattattgcttcatgcacttttgatatgaatattcatagaaaaagagaattgcacaatgtctttgaactttaaactgttgctctggtatatcaggaaatgaagctgccttctgtgagattgctgcagaagaaaaaccagaacatttgccaagttatatgaatttacttattcaaactaagttcaaacactttgtatataaaccttaagtttgttagattttgttctggctgcatcaacctttcagtgaagctactattgcttttttagtttcaagtcatttcttccttcaaattaaataatttcttttctcatgtcttacacactactctctacttcatcttgggatgtcaattcttttatggatcattttggtttctgatggaacatgtgcatgtgttatttcattttctaattattttagttttacagccgcacggatgttacctttgttgttttttacatctagtcatttcagttaaatccttatgttcttttgttatttgccactcttggaccgaccgtcagttttccatagtttctagacagttcttacattatgcaaggaattatcattccatatgaaaatgttgtacttttctttttcctttttattttgtggaagaataattagactgactactaagggaatgctagtaattttctcattcacccagccaaattacttgagattactttgcttgaaactgaacaatatttgttgtatagtaactggctcacctgattctttctaatctgctttggggtctctctctctctatctctaatttggctatgttcaaaagactctgtagttagtattgctttgttcactctcaaatctgccttccgaaattgttatatgtgatttggcagggaatgaagcttcttccaatgagacagctaataatgaagaagttgaaggttcttatgactcagcttctttttttttccatggttaataaatcttttccattcaagaatctaaaagctgctatgcttgacatgatagggatgggagctgcaccaaaagtctctggacagcttgttataggtggaactcctacataattcttgatcaacgtttcggacttattttcttgtttagaagtgcatataaatgcagtatcctatcaagcatgcggtattccatatcagatgtctagtcacgtagaaatgggtattgcttagttaatgttggaaaatttagcttgtgaatccagcttagcagttggtatccttggagcttgaagttcactgatagggactggatcttccatctgatgactgcatatattgttgttcatctggtttatttctttggagattctgtttaaattctaaagtatgtcatggcttcagtttgcgtcagttattagatacttctttttctagcttcttattgctcttatggccgtcttttcttatttgatagagttgatatcttaataaattaagtgctgttactgaactagcagggaatagaattttctgcctaagaagtttaaatgcaaagtgcttgtatttctctaatctgttaggactgtttatgagcaatgatattttctgtgcattgtcaatatttttttggcattgcgcatgcccaattttcgtatccacatgggcctctcttgaaaggttaaggaatccgatattccaagtcatggagatttatgacttaaatgaatcacaagctttgcacctatttgttttttttctgtcatttctcatctgcagtttgtgttttaggtgtttaattattgttattagatcttttgctggctgatgaaagggagaaagcatgttaaatgctgtcagtattacatatgtttccaatgcaaccccaagtttggaagctacttatggctaggatgttccaaatggctgtagccactctgtttcatggtagaatcgtcctatgaaaattgatttccaatacacatcccacagggacatggtatgtggttttgagttgtctggacttcgtatgtaattagcctcatggaattagttggtttgggagatatgattatgctatagggctcttgaaatttaactcaggcttttacaggtctggtgaaaaacatggataaattttaggtttcctagaacttcttcgctgacaaaaagctatttcagactgaaatgttgggaacaaaagagtaaggaaggatctacaagaaatggttggattctgccttagttttacaagtctaaggtaaacgaggttgttactggtttacttcagagacagaagtggtttagaaattaaccagaaaagatagaaggaagttgataacttagaagctgtcatcttaggagttcttaagtaggtctgcaggaatcaggtgcatataataattattgaaagaagagacagaaaacatcttaaattattgaagtgtatcatacgcaaggggactgaatgattggggcggatcaacatatcagcagattgctggtaccttctagctttaggaacacaaaacacaaaatgtccagaaatccttcttcccaaggagagagtaaaagctgacaattgaaaaaaaggtgaagaaggaacttaaaaaattctggtcactgtggggttctgtagacaaagagagctaaaacactcaaaaactgagtctaaattattctagtaattcctgagagctatgactttatcgggacattagacaaaagtccagagctataactcggtcaaaaggatcctaaaataatatgctaaaggcagtgccaatcaaagggtacaaagcacacctactgtttcattctctactaatgcacgacctttaagatcatatgaaacccattgattctccaagaaatcctggcttttattaggaattctgttttggagttaaacccaattaaatgtgggagtcctgtcagcctgttcgaaataagcaggctaagtgataaatgaaacttcaaaacactgccttaattcaggaacaacaaaagctaacctcctgccccttcctccttatcttttgatcagtccattcatatactttcaagtttccttttgtttttctcctttcatcttcttactgcatgagggtttccattattcctattactgtttctattattactgtattttctgttgcaagctggcttaacaccatcccccctttatatctcatatttaatggaataacagtttggaccatgaatacagaaagaaagcatttatcgcttttccatattgacatattgtttgcattaggtatttgtgttccatggatgaagaggtatattcctttcactcgaagtgacatcactcttctttgcagaaagtgaaccactcaagttgagtgtaataaatgaaaacagcagaaccagccagataatcgaaattgtagaggataaagaaattccaaggtaccagatgactgcagatgtaccgatcattgatttagatgaagatgaagatgactgctcaactgccttaaaggaaaatgatccattaacaacagatacctgctataagattgttgaagcagtgatctctgacaggcagaaaatatggcactatattgacccttcagggaatgaacagggaccgtttgcattggcttcgctgagatactggaaggaagaaggcttctttgatgatgacttcagagtgtggagagcaggtcaatccaaagaggatgcgatcttgttgatagatgccctccgttgaagtcataattgctgactatttttacatgcagaatctgaaggcgtagatcattaattgtctcacccattttgtagaatgctctccccaatttcctctatacaaaaaatgagtgttgaattttgttcatgtaaaaagcagtcatgtgatggcaaaaaaaaataccattcaatgatatactgttaaatccccgaagaatttgctgttgctgttgtctaatctgagctttatttcgtttccatcacatcctgaagaattatgtgactgggcggaggttaaacagggaatttaaagaattttgctgctgaatattgttctggtggtactcatctgcagtcagttctttgataaagtcagcactttattttcagggtattctacattttcggatgttgcttctgttccttgtcttgagttgcagcttacaatttctgatgtgcacaaatcctggatgtcactttaggaacaaaactgatttcccaggtttgtagagaacaaagaggctgaccaaatctcagtgcatggctttcataacaccccattcctcgtattctgaaaatggatttgcagatcaaactaggtgaacaactataacttatcctagctgcaaatgcttcacattagcatataaatccaggtatgacttaccaaagtctgtgaatgtatgatgatcagcctttactttacactcatcctttgtgacttgtcagttaatatgtttctcaagctatttcaggcaaaatgcggctgcaataaaatctacattctcttaatggataggatatactggcattgtggtatagtatataaatttcattaaaagtttcattcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtgtataatttcgtgggtatggaacccttgtgtgactaccattatgttctccttacttttaccagccttaactagaagataaccaggataatgttgagaaaaactaaaaagaaaaagccctcaaatctatccatgcctcctgccaaggtccaagggttttagccatctggaccccatcgtataaaacccccctctcctccccaaaacctaaccaaagtagtagggttttcgactcctggttctctctcgttatcaggaggaggagagcactcatcatatccccatgtcgttgtaccgccacctcctccgctccctccaccgcgccgccgacccacggcctctcgtgatcgcccgccccttcgccttttcctccgccgaggaggccgccgccgagcggcggcggcgcaagcggcgcctccgcatcgagccccccctccacgccctccggcgcgacccttccaccccgccccccacgcgatcccaacgccccccgcctccccgactccacctccgccctcgttggcccccggcttaacctccacaaccgcgtccagtccctcatccgttcgggggaccttgactccgcctccggcaccgcccgccacgctgtcttctcctccgtccgccctaccgtcttcacctgcaacgccgtcatggcctccatgctccgcgcccgccgcctcgacgacgtcgtcgccctcttcaccttcttcttcaaccagtccaacatcgtccccaacgtcgtctcctacaacatcctcatcaacacccactgcgacgccggccgcgttgataccgcccttgacgtctaccgccacatccttgaccacgcccccttctcgccctccccggtcacctatcgccacctcaccaagggcctcgtcgacgccgaccgcatacaggacgccatggacttcctccgcgagatgctcaaccgtggccacgccgccgactccctcgtctacaacaccctcatggccgccttgatcgaccgcggcaacatggacaaggcccttgagctcttcgacgagctccgcgagcgctgcctcgtctatgatggcgtcgtccacgccacccttatggagggctattggaagcgcggtatggacaaggaggccatggagtcctaccagaccctccttgaccgccagttcaagatgagccctgccacctgcaataccctcatagagaccttgctgaagcacgacaagcgggccgaggccaacaagctcttcgagcacatgctcgacaaccacacgcctcccagctttgccgccatcaacaccgacacctacaatctcatggtgaatcagtgcttcaaggaaggaaagtttttggaggccatcgaggtgttccaccggacagggaagaagccatgcgtgatggatgtcggctgtttcaacaacatcattggaaagctctgtgaaaatggccttctttcagaagcagagaagctgttcgaagaaatgcctgggaaatcggtgaatccagatgcggtgacctatgggtttttggttgacacatgtttcagagaaggaaaagtggatgatgccgtgcggtattttgagaagatggtgaacactgtagaaggggctccaaaagttgatgtggggttctacaacaaaatgtttgatgtgttggtcaaggcaggatcaatcggtcatgcactggagatttttgggaagatgggggagagagcacttaggccggattcagctagttatgagattttagttagagggctgtgcgaggaaggaaacctgaaccaaggacgggatttgctggagcagatggtgaggtgcagaataactgtgtcacctgagttccataggtttttattggatgcttttggtaaagcaggacgaggtgatgagatagaacatctgttcattgggaatgcaggcaatgttcctcctcaattccaacaggtagcaacctgaactagaatattctatgcttcataaagcccttctccaccattcatgatggaagaaactgaactgacttcttagagtataaatttgaagcgagttgttttcctctcgggagatagtattgaagtattagggtctggtggtaattgttgtgtcttcctatgaactgtgctatctgatccataatatttatgattttggtgtatgaacatattgaaaatgatttagtccatgtcctaaagctttatcagtttgtctagtaaaagcgcatgagtgattcattggtgatacattatatgttttccctttcgtacatgtgctgttgatttaatatgttgtctcttcattttgtttgtgttttaaaatttggtcagcaacatttttgtcaaataacttctctcgttttggaggaaatactaactttaatttggttgcttgcaattgttattataagttttcttttaaaaggtaaataaactagtagaatgtatgacatatgtttgtcatgttatgtcacagctgtatattcatcatttattttcatagaaatctatcatctgcaaaggctaaaatcaactatagaaagcatttctgtatgctagataagctttgttataagtggaaaagtttctgttttgcgcactttataatacaagatatctccttgagcaaggagatgtctttaactcttatttcttttgttttttatttgtccaaatatgtctaaatcactgtgtgtggagcaatattaagctgtgaatagatctcacaagcatgcttacaaaacaaaattaatgctcagcacactcaagatttccatctatgggtggtttgcaaggtaggcatgtggcttccacacctaatcacaagcaattagatgctaacctctattcttgggttcattttgacattagtttgttattgtgttaatactttgtttcaaacatcactatgcaaaatgcaagaccatgtgcacccctgatgaaggggagaaaaaaaaaggaaaaagaagtgtgaaaggttaacagtcagtcactactcagttctccaatcttatgggtgatcagttgaatggtacccatggccccaatgaagaaccatccacactgtgtactgcaccaactccagctgccacagaggaccaatgaactgagcaataactggatggtgatgtctaacaatactcaaaaaccatgaacgataaaaaggtcttgcattaacccaatgaattcatgaattaaccttgcatgggaagtcttttttttttccttgtgacaatatggaatgtgaaagaaaccattcatggagaggggttagtatgactgaattagtaatagggaggatctaaatgctactgaccaatgttgtcatgggtttcaaaaaggaattctatatggttgagaatcttctgaagtaagaggtgttatggttggattatgaaggaatatgtgatgatctgtttctttgaaggttgttttctcataattatgatggtgagatgtggagatcaggactgggtgatgaacgacatcattcatgactttctgataggtggtagcacttatgctaagttacatggagggactgatgggtttttagtgctgtgcaaggtgtacagtgtatgtctcttgcgactatgctccctggacacctaacttctttccttgctctgcgagctgcttatcaggttccacatgtgagccacaaagttaggtacactgtgtagtgcatggtgtgggcaagtgtttagatctacagaatcttgcatctctagcatgtgtctgggttcagcaacgtgtattatgtttttgtgatttgttgttaaaaacacgggatgtagcatggcttgaccaatgaaatcctttaaaattagaaaggtcttgattgatagagcaaatggaggtgcaatctcctccctttgtgatttggtgagaaattttggttgattagaattgtctccatgcatatatgcctgaggtctcatctgcagtgaatataatactactaattcccttcactgaagtatttaaggaaacaaggaaatatgtattcattcaaattcattggacatcaagtttggccttcttggagcattctgtatcataacaaccttagttgttctccatgttagcaaggatctgattatatgtcctgagtaatcatccaataattcatttgtattatcctacagagttttcctttagaataataccatcgtaggttacttgaagaaacatttcatgctttctaatgctaattgataattgcctttgagccactcctacttatctatattggaagacaaatatctagtttattgatgccttgaagaggtacatgttatttgttggaaaatactcaaatggccattttgcatttcttagcttgtggtagcaagtgacaatgggcattcaagacaaatagataatgggttgagaggaagggtttcggtgaagttgggagaggaagctagtgagtttattacaatgtctgatgagaacctgagtgaaacaagggtgatacaaggggattttcttttgttcttgtggtagattcactcactttgctcaaagagaagctcaaagagagttcatatttttcttatgcaagcaatctaagtgcaagttagcttttaactaaagctgatgtagttttagccctgcttagcttatcaaatttataagaaaaaggatgaaatgcttaggcctgacaaatacattaggaaacacagttgggggagaagttatgccctctttgttgcaccctttgcatatgcaaagtgattatgtaaatgctatctgcatcctgtaattacatatgaaggagaatcaagtgaatatggggatggtggtggatgttgttgcctggggaatcaagagtgcatatggttgtgtgattggaaatggacaattgacagccattgtctgctgtagctacactaggcagctctatgcgacaaagatggtaataagacctgaaattttgtaaggttggtatgtctaaggaccctattttgggtggggaactatttttcaccatggtgatttctccagtagaagtcaaaaaactaaagaccatcattgctggtgcatagattaattgagacttttttagtgaggtagtgatccagtgatgagtttgtcaaggcagtcatgttgtcgaaatatctgcatccacagtgatgaataaggacatggaagatacagtgacatgcaggacacgtggttgttgtactttatattttgacaatttgacattgcaaggataattgttgtgtctcccttgttcttttcggcataaattattgttgatgatgctttttataggataattgtgatgcctcccttgttctttttggcatagattgttgttgatgatgctgtactttctaaactttattttaaaggaggttatgctgctgattaggtgttggatagggatgggaagggtaggatggtcaatagagtgggtgtcgatgcaatcaataagctatgctttttattggcatgatggctgtaggtagctattttcttaaaaatgtttagcaagttgtttttgctgctaagttggcagttgcagtacttctcatgcagtgaagtggaagctaacttggtgagtctccatatgttgcaatttgtagggtatgggtggcagatattggtaacttagatatgtggcgatttgttgaatccaaaattcatcaaatagaaaggcggttcacaaaggagaagagagtatactaggattcaacctcaaacaaatatcttttgaatgaattcatcactaaaagattgggatgcctcagcaccatataaacaaacttgttttgaatcattgacgggaccagaaaattccaatcttgaagtaaaacttaagagaaaccataacaatggatataagcaatctagccctatccctcatttatacaggaggcagtaaaggaggctatagagttgaatgatttggatgtagtcttggattgttttatttttcttctcaagaaattagaaaagatactaatatattgttctggttgactgtgtgatgttggtaggttgttctgtataggtggaaagtttacagtttaaaggtgcagttctagagttgaacatatcgtcagcctcctaaatgctgtcatattgaattttggagaatttgagtcttggcatggttatatctaaagaagcatattatttgataagttcaattttttccatgactttcttacacaaaagactattagttgcaatattatgaccagaaaaaagttgcatataaggcctttgttataaagataagattatttcttgtgatattagtctagaaaaagttgtatttaaggccttgtcaaggtttttatgaggatcatctctgcttgccctagtgaagcaagtgaagttcatgaaaaagtatcttttagttgggtatttctccttacaaagtctcattgttggaattttgctactggaacttttgctagatgcacggtctgattcactgagattgtcaccaggacggtgtttaaaaagttgaggtgaaagtactattttggcatccctcttatttgtttaaacccagagtcattcaccgaaggaagcaagagattgcaaagaaatcactggcagttgcttatgttgatgaggctcccttctctcttacatgtagttcttcaaaaatgattcagacatacatatacccagtaatgtaccaatatcaataaccagatatagttattcattagatagagcctgtgctaagagcagtcacgggtcatttcattgtatgccagttaattctgttctcaaatattatgcactagattgtcttcagtgacgtgacttatttctgctgcagtaactaaaagagcttcacagatgtgtgatacgttctcattatcatggtcaattagatggaagctattgttgagaagaaacgcgaagcattgtttgccacagctgttccatccacaatatatcgttggacatgcaacataacttcacttatttatatcctcatgattcatctgtatacctttttcagtttttacagctctaattcctaaaatttgttcctacatcttggttatgtatgggataccatgattagaccattatatgctcttggtacataaaaatatttttgctccggacgtgcttacctcttcttatctgaaatttcttgtatccttgagggcgagcaaacttatctaaggcctacttattatgtaagatttatcgggcaagaaatgctttgggatcaatatgggaattagggggtgtgtggttggggcaattaagatttagaataggaatcggaatggatgactcctattttaactgtttggttgtggagaagctttttctgattctcattccaaagaggaatagaaatggtccaatctctcctcagttcaattcggattcttgttggattgagatctcattccaccggaatgataattaaaaaaaaatatcaaaatcgacatgttttagctcgatgtcgtcgtggaggtgatcggtggcaggggcagcgttgggatcattaagttcgatctcagtcttacggccataggaggcagtcgggcgaaaggagtggaagacgagacaataggagaagcgggcagcgagggagggggagaaggcggcgagttgggaggggagagaaagggggctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactgctaactaggaatttgagattggatttattttttttacttaaaagaaaaaagttgtgggccaccctttattagtatggatggattagttttttttttaatttttaattaaaaataaaaaataaaattttgagttgattctgatttcattctttgtatgaaccaaataacaataataagaatcatctattccgattttgattctggatatgaatcaaatgcttcagaggattaggtcattccaattccgatttcaatctttcgattctcatttcaatttcaattttgattgcgaaccaaacattctcttaatgtgttttttaatctacagtatcaactctctttagtctgaagccaggttggttgggtgatactctggcctagtgctgctgtgctaagtctgataagctctagcatctaatgctctatcaattttactgtattgtcattatattttgattgaagtatgtgaacatgattaatgcttaaatttttgtttatcttcttcacttgagatgagttataatcaattatccatatccatccgagttaactggatgagagttaatcttgtaacgtttgtagaatctgttaccttttcttgaaatgaggaaaaacttgatggattgcaaaagtagcaaggataaataggggctttgatcactcttccactccatcaacagaaagtgtccttagagagggccatcaatactctgatcaaagagtggcaaaagaaggccaatatgctggactccctctacgattcatgacaagtttaagagctgtagaataattactgaaagtatatagtataatttctgattttgcttaaccttgagaacaatattttggagagagaagaactaagaaaatcaggaaaattgggttggataacttagctgttgctgtttaatttttattttaatttaattcaaaaaatcttttgattgctatcaggataatccctctccttatggagattaaagtactctgttgactttaatggtctgtttttttttttgattagtcttcagccatccttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattttcaataaaaataaattcaaacataaatgataagattgcaagtataaagcacaaaaaataagtaaagagaggcaagcacaacaaacacaaagaatttatagtggttcggtgccaaccttgcacctacatccactccccaagtccctacttgaaaattcaattcactaaatggatttcaaggattataccacgtcggacacttccaactcttactatccaagtaagaatacttattttttaggtacaaccaatcctcaacaatttaattcaagattcggatcaatccaaccgaattttggaacccccaaaactcaaaaaaatccaaatacaatataagaaaaatatggtatagaaaattcagcacaatatccccttaaatagacacaataaatataatagaaatataatacttaagaggaagaagcttttgctaaacatcctcaatggattgcacatttgattgctgctggagagtggttggtgaagtgattaaatacttctatttctctctttagggctgatagagcttttctcgaatttaaacttgaatacttgcttaattttataattttttacttcaaaagagtatttatagtcaccatttacccttgagaatgtcttagagttagtttagagctgttggagagtgtttaatacgcattaaatgcatcaaaaatggattgaaaattagccgttacgaactcatccaaaatggatcgtcctattgtgactgaaaagtcccatgagctgcctcatttggccagtcaaaaaattagattttctgttttgatcttagggtctcaggggtcgttccaggtgagtcatcccactgtatgagttgtcccaagtaggtcgtcccactgcgtgtcatgagccaaaatgaaacgtaccagttactcaataaaaatagatgattcagatgggtcgctccattttgttgcaactcaatttttcatacatttaaggttcgaaacttaccagaacactttcaaacgctctcagatggcttcaaatcaattggacactcttagaaagcttcgaaaacttcttcaacttgcagaaacttcaactttgacacacttgatgaagcttttcaaatccaatattttagactgtctgaaacattacaagaacattcttcaaagataaaaaaatacattagtagtccctcaaatggtttatgatcatcaaaatcaattcttggagcaacaataatatattaatatagttgtatatttttcttatagttaatgattgctgtacaaaattatataggattatacgtagagtcagatattcggatatggatcgaatagttatctatctatattcatatctattttttttaataaatatgaatatagatatggatattaatcgaatatttaaatttctatctatagatttagatatgaaaatagatctagatggatattctccatatcacgttcacccctgccatgcaacaatagcttcaaatattatcccaataatgaataaaacaagtataaagataagtattttctaacttttttctatgagataatggatccaaacagccacattagaatgtgtgtctttctatatttgggcttagtatggtaccacatagaattggatcttttccttatgaaatttttgtttgtatatagaagagcactagtgtagatatagaaaatcggagggacaggaggttttgattgggtgagaatgagcatattaggacaaagggataggggttcctctctcttcggtctcaatccaatcatcgacctttattctcttcctctaggatgagagttttgattatgataaggaagctggagttggtgttattcaactcgatgatgaagtagaagacattcaagccgttggtggagagaaaggtggggatgtatgtctgtagcgtcactccttatacttatattcctgcacctatatggctttcaacatcgatccaaccctcatcattttcctcttaatctttgatattattttttttgcattattttgattgcattctatttagatttcttgaatttgattattaaacaataattatttttcaataatattattttttaaataattaataattatgaaaataatattttaaatatgatatatattttaaataaaaaaatatcccatgcgatctagttacaatgaagaaccaacacaaacacttaaaatatgttctgaaggccaatgtaccaatgctaccaaaaaaaaaaagaccaatgtatcaatacaacacaaattgtacaaaatattagaactatcaaaatgagtcaggcccatgggctagcccatttggccctaaaaatggaccagattaggctgagaaatcctgacccatgtatgaaagtaggctttttagcccgacccctatagcccatggattgaactgggttaggatcgggtcagcctgtggcctggcccctcctgtcaggcccctcacccttcccctccccatccacccttccctccctcaccggcatcgagaatgtacgcgacctctctccccaaaactccgccgccactgccctcatccgtgccctctccctcctcagttttgacgtactccgctgaatctgatccatccccacccaccctccgccctcctctccgacttcatgcttggctggaccaactgtttcgctgtcgaccttgaagtcccccaccttatcttttactcctccggtgccttcgtcgtctccgtcatcaaccacatctggctccgcatgccctgccacgaggatggcgacaaccccaacaccctcaccgtcctttccgacctccccttttctcggtcttccccttcaaccaccttcccaacctctagcgccggttcagggccagtgacccgaactgaaagtttgtatgggagggcttcctcgccaacgctgctagtagctagggggtggccatcaacaccatcgacgcccacgagggccccttccttgcccacctaaagcgggcctatcatcgcatctaggcggtggggcccatctcctcattcggtcccatgactgagagaggtggccggagctctatctcggtggaggaggtggcggcttggcttgacgcgtgcccgccgcgatcggtggtgtacgtctgcttcgggagccagtacacactgacggagaagcaggggtgggccttggcggtggtgctggagcgcagcggggcacgttttgtgtggaccaccagttgtggtggggtgttggtgccgaagggctttgaggggcgggtggtgggacgggggctagttgttagatccggactggccctagaaaaaaaaaaatgggctggtccgatcctaacccacaatccatgtgggctagggccgggttaaatttttacagcaccttttaataagtgggccaagcctggtcaggcccacataatcacagcccacgtgggttagagccgggtttacaaaatatgcagtaagagttaataaatatttccatcatgtacattgtgttatggtttattagtttattcaatataataaattccacgacttcaacttctgcacctgtatcttccttttgatggaaagtataaatacttcaatacggtgtctatatgggaagaatgataatctgagacaaagttccttggaacaaataggatgggggtataggagatgtttctccatccttccacatcaaaatgatcaaaatcaataggcatctaaaagaacataatgatatcaaagccaatttgcatcaagcaattggtggctgattgtttatcctcctttcggcccaaccggaatttaagcacatagtttcaaacttcgtatattctttgctgcttctaattcccccttttcagggcaatgggctgaaaattatgagctgacttcgaactcgtgtggcacttggattaaccaaacagtactcgaagcttgtgctagccttggttgttttgagaacgagatgagaatgccccttcctcgttcttttttttcttcttcaaaaagtataatgggatgccaccaccgggtaggaaacattggacctcatcttcaaactgggagggatgctgctcggtgaagttaaggctggctggcaattcctccatatctttagttttcagccaaacattgccaaaagtccaagtctggtaaccaaggatgcttcgctcctggttcttgtttaccttcaatgtaagaattgctggggtatcaaccaagttaaaagggtttgatgacccaccatatggtgacaacagagagcttaaggtttaaggtcaagcaaacaatgtcaatttgcatcaaaaaaacaaaagaaaaaaagaggaacaagatggactaatggtagaagaaatagaaagacaacttgtgtagtagaaatggattggaatgggcttaatagttcgtgactagaattggaattggtacgaatccgaatgattatattctcaggcacgtttgattcatgactagaatcagaattagaatagaagtggtatttaaatactaagtgagagcctagattaaattttagaggattgaagcataatttccattaaatagaactcctctccaccaaacaactagaattggagccatttattttcattctccttctacagcccaactcacatcaatcaaatatatcctgagctatgatgagttttttctgctctgttttctttttttgtacatcttgtccaaaatttaggtgcaaaataaaattgagtgtaaacaagacttttttgatcatttatctacgcagaacattgacctcccgtagtttctcaaaaaatagaagaaaaaccttcatgagttagaaagttggattactaaaccagcaatatatatttgaaacaaccatgggttaatatttgaatttaggcagttaacctgtcattggtcctctctctctctctctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaatcaagggttggattttggccagaaggcaaacggcgacaagccaataataaagcgaaaggagttggaaatgatagagcaaagaaaaatgttaaagaaatgaaaaatttttatgataaaagggtgaacgagcaacctgaggccaactttaaataattcttcatataggccgattctatctggtggaggatcaccgatcctgtagctaggccttggggactctaactcaaacgagactgggatcccgtattaggcctatattagatttagatctcctgaatccagcatggatctgatggtgtcaggcacaaaagatggttcaccctcatgcccaacatcagaaccagtagggtcttcccccaaagcaagagaaagctcagaagaccaaccctcaccaaaaccatcagagctaacattagagaacaaaaggaggaagaagagaaggagaagggccaagaaaagtaatagggaatgaaaaaagagaaaaaaaaaggaactaaaaatcagtaggagaatgaagaaatccacctacgatggtgcgggagatgaggatcgattaatcaacggaagtcaccgaaagaagtcgtcagtaactcaaagaaaccaggggagatagccagaaggggaatgcctctaaaagcttgaagaaagtcagaaacttgatcagaaagaaaaggaggactctgaaagcataagaaaagtcagaaaagaaatgcagcccttttttataagcacagaaagaatggtacagtttggatatcaaatcttccctgaccgttggataggtgacgtctggtgtacccctattggcccacagaaatcaatagttggcttatttatgagtaacactcagaatgaagcacgccattccttgaaccctgcaaatctatcctacctttcttgatcatgattaatctctgacgtgactctttctttcttcgaaaaggcacaagcacgtcatagtcgtaatagaggcgtgtcttctgcaatcgctcactagcatactccctacgtccgagccctactcgatttgaacttgggagtaaggaggtatgtgttgggggggataatacattgtcacgctgaagatgcatggcaacggagatcttagtttgatttagtttgatttggtccaatcctgcactcaagatcgccaccacagtatcgatcagtggtgaatgagtataatcttagtggtagatatattacctcagaactgtgaaggaagctacgttaaaagaagtcattcaatacataatgaagcagcaggcctcactctggatcctgtcgatctccatcctcttactgatcctatcggatgaagctcctataatgggtggaggaaggcccggccaatcccaacttcgaacaccaaccccaacttcggctactggatttggttttggttgtctctcatgacattgcccatgggtccctagccactggcactagggtaacgctcgaacatcagacgcagatccaaaaaaagacttgagcccgatgtcgtcttcgaccaaggatcctacactgatctccatttttagccgcaagctactctttcctcactacttactggctaccgcatttgggagagtcaactcccatcacatcatgttgcatcaccccacatggggccatacatctccaatggctagctatgcgccagatgaagccacgtcaaatcaagccatcttgtgagtggctgactgtgcatcggataagatgacgtccgccaccaaggtccaaatagggaggaatggttacctagatcacacccaagtaaactacttaagtcctaggcgaataacacaccacgacaacacttatatttcataaatccggacatcctgggtggtatggataaagaggtcgaaatgatctcccatctttttttcttattatggcactcgtctccctataaatagagataaaaagagactctccagctatgtatattcgtgcaccctctacccctctcgctcttcttctcctttgttgtatttttttgacttgggcgtcggagtatttctctcagaatcaacttcgatcggaacttattttgtagatcacactgcttcggtcatctccagtcaccctgaccaaagtcagaaatatcccgcaacagcttttaaatttatattggtattcatattcaagcaattcaccatatagtaaataaactaaggaaatgatatgcatatatatggaacaaccattagtttccatggtgtcaattttttatcaactttcaaatcattataatattgtcctaaaatttagttaagttgactattatgctgccagaatgcttctataaattataactgtgttgatagacagacactattaacataatttcttggaaatagaaaagcacctcctaaatcattcaattgaacccaatcctaccacttatttaagtcaatgtcatatggtttgatattattttcaaatttatcaagaggatgtctagtgtttatgagtactttaaaaaaaaagtgctactacaaatatgctgccaaagtgatgcaatttaagattttttgaaagttaaaaaaatgaatatgatactcccatttttagataatttgttaatattcaaaaattcttaattagccaaccaagtcatacacattaagccataaaatcctaaatatttcaaacaataacatgttagaatgaaaagatatcatagttagtttatatagtattagctaggcatatcaatgaattatcataggacaacatgattatataaaaataaaaggatattgataaacatttcgaacaaatacaatcaatatgagtacaaatgatttcgtaatgttgaatgggaatcctaaaatatactaataatttaatatattacatgcaatttgattttcttaacttggaattttttatgttagcaaaagcaacaaattttttctctcgaacttgttgctatcctaaaaataatattttttttgcaaataattttgaaagatctctcacagtatattttttttgaactccctatcgattaatgatataagaagaaagaattgtaatgataattaaataatttaaaaataatactattattgattggtatcattggtttgtacaatttttaattgatttataaataatagttttttattgattgtactatcttatatatataacatatatatataatatatatatataacatatatatatatatatatatatatatatatatataatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatccctatttaaatcccgtcccttcttccgctaggttcgatctaatcgatcttcccgaggctccccttccctagatttaatcgaggtgaggggaataagagggcggatttgattggcttcgattcttcttcaggtcattctcgtgttcgatctcgatccctagggtattcctttttctctctcttctgcccccctttgatcctcttgtgtgcttgcaaatctctatcaaaattcgatctttattctcttttttggattcggagctgtggctgctgactagatttgagggatttaggctttccacggttgtgtgattcttggctgattcctgtgatttgagggctcttggttccgttatcttcggagccaaagaagcgattttgaccacctatattacttcttccatcaacttggagctgttgtcgatcggtattttgctatcgataacgagtgattgcgagcaacttgaagacgatataagaggaggaatccagtgtttgtggtggcagatgaagccggtattgaagagcaaaatggccgacgaggagggagattacttccccccgacaccaaggaagggctggtcgatcggtctgatgaagttcgtctcccttctggttgttttcatggcaggggcggtgctgggcctgtcggtgagcgcccatttccacaagtacttcagctcccaggccgatctcttctttccgaggaccctgtacacggcgacttgcgacagggattgcatgagcatcaagagcttcgtgaatccgtcccatttgatgcacgccatgaccgacgacaagctcttctggcgggcgacgatggtgcccaagatggaggattaccccttcgagagggtccccaaggtggctttcatgttcctcacacgggggcctctgccgtttgtgcggctgtgggataagttcttcaaaggccatgagggcttgtattccgtctatgtgcatgcgcttcctgactacaagctcaatgtctcggaggattctgctttctatggccgccaaatccccagcttggtaagacattaatttggtctatgtttattttttttattcaagtgtgatctatgaagatagacttcttggacttctcattaagtttaatttcactagttgcaagaacttgggtaattcatgtatttccgatctttatggatcatatagtgactactaaataagcaaaaacagaaagcattgaatgtccaagaactatatcattggttctgttcttttaaacttcaaacagatcgatagtattttttttttttaatattagattaatttatatccaacatttagtagagttacttagaatgtaatttggggcattgtaatacaatttacatctatggagccaagaaaattgattgctgtcatgaatgatgtttccgagaaggttattttaaacattcagattcccctggattagaaggtttcaagcaggcaagtaactagcatttttagaatgtaatcaaatgtctcttgcaatgcaagtattaacaaaatgcatttcaaaatctaaatatgatccgcagcgtataccaacaatggttgcagacaggccttaatcttcatataatagttaatgtgaaatttctgaaaaatttaccggacatcctctctataacagttggcacaatgttgtaagacaccataaaagaaatcagaaagatattgtaaaacaattataactacataaaagaaaatgacaacttggtaagataatgatgcaaatcattatttacattatttctagaagtatttgttgatttcagaccatttggaatgaatgattgttgcttttttctttttgcatctaacttgcatcattcttctgtgttcctatgcaggaagtttcatggggttcggttactctggtagatgcagagaagcgtctcttggccaatgctctcttggatttctccaatgagcggtttgttttgctctcggagagttgcataccaatatacaatttccctgctgtttatgagtacctcataaactcacaccacagctttgttgagtcctatgatgaggattcgctgcagggccgtggccgttacagacgtggcatgtcccctcatatcaaactctatcaatggagaaaaggttctgagtggttcgagctcaaccgtgaattggctgtgactatagttgcagactacaagtactatgccatcttcaggaaatactgtaagccttcttgctatcctgatgagcactacatcccaacttacctgaatatgttccatggatctctgaatgcgaaccggagcttgacatgggttgattggtcaaggggaggccctcacccagcgagatatggtgcttcaaatgttacaccggagtttattcaggcattaagaaataatgggaccttctgtatgtacaattcgaggccgacttctatttgtttcctctttgcaaggaagtttgctccaaatgcattggaacctctactcaacctcacttcaacagtaatgggtttctgactgactttgtttggcatgctgatttattgccttcaggagatactccattcacttctcagtgatcagggaggaattattctgacactaccaccagggcatccttgctgcctctggattttgactagaggcgagtctcggattattttttctgatggacggtgtagcagattatgtggtaggcagtccagaagttgcttaatggaggatgtgaaggtgccagacacggagcttcaatttcttattccatatcctcagttaattttggtttggtacaagagatattgtaatgcatttgttcagatactcatctgtaaatatgaattcatcattcgttttgtcattttaagttcaacaatgccattgggtttttatctcctcgatgttggtagcagcttaaatatttcttttcatgccttgaaagtggttggcagtgtttggtgtatattccaactcttggatgatgattgaagagagaggaatacaaagtgaaacgtgcttgcacctaacaaaactcatggatagattttttttttgccaaatatagtttatttattaggttttcaattttcatctaacatgtacatgttgattatggtttatttaatctgaaaacatgttctatggtttctatgtcaggttttattagtgtaagagaaaagggattttcaattaggaatcgaataattttaatatatatatatatatattcagggatctgtgaacagtgcataacagcaatgttggtgagacaaggatgcactattttcaacttgatcgatagatgaagtctttgtttagtttctgaacataagtctttgtttaggttctgaacatagatcactagatggcatggaattatatgtctgtttctctaaacaattatatcagtttagtatatagttatacaaaacaacaaaataaacataaaatggcgacaaaattgatgaagaggtgggaagaaattttctctcagcagggatttaataaaatatggcagtcaatctaagggatgaactccaagtaaccaggtcaagtcaacacaaggtccatcatgaccaaactcatctgcatggcttagtctaacttgtccaccttcaaactacaccagccatttggctacatatcatccatttaggtagatcacaatatattattcaaatttttaatatatataaaaaaaaaggaacagttcatcacatttcattccatttatttatggtggtcagtcttgacccaaagactacaaagagatgaatatttgctgaaatgaactgcttttctctagtggaacgtacggaatgggaggataagaaacttgtatgcaactagttgatcaagcttgtgacctagcgtggaacttcctggacatcaactcagaatgccagttggaagggttaatgcttctaataagcctttaaggaatatatatatatatatatatatatatatatatatatatatatatatatatatatatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatacgaagattctttctccactttctctctctactttctttctcatgaccgtacttttttatttaagaaggtctatgaatcctgtactgagtcatgccttcatcttttaggggctcatattgactctaacaagatgatccgaagttgctttaatatccatgctgtatgtcaacctcatttgatcatatcaaatatctttcaaattcatgattaatgaactctattgattgatcttgatttaatctgtgcttcataatttcttaatcaagtcacttaaatctgaccctcagatcagagaccctgaattgctccggtatctggatggtccgacacatgcagacaacagtcatctttccttatgatttaatcttattatattcataaaatagaaattaatgatgatttgatattttaaataagattagttgattcttctaacgaagtctgaagatctaaaatgaacgaggtaagtggatcttacgttctttatttatttttaaataatcatatttttcatgcaaagaactattgttgatgaaatcatattttttataaaataaggatcagcacgtgtgatatgaaaaattatattttattatgagcattgattttatgaatatattttataaaaatagcatgattatgaagcatgaattttattatttttttatttatgtatatgtatgctttaaaaaaaagatataaagatttcaaaggctctcagatagctatgaacgaatctcttcggaaaggtcgacatccagagctagcatccacacgaaacatagccctgccaacgggtataaagttggcatatgaattaagaactctgtcgattaagaaatatggccctatcacaggtataatagtgatcttagaacgaatatctgggagcaatatatcaaaacttgacatgaatacatgataagaatgatttatgattcatgattgtgaaatatacatgattttatgcatgcatgattggtttataatttattttattatatgttctatgaaatattttattttatattatctgttattttttaaatattacattatcatgaaaaatttatgcttgattcgataaagaagtgtaagttttacttactagactagtgtagccatattctttttttgtttgaacagaggaataaggttaagaccggcaaaagaaattcagatttagagatctgcgatgcaagcttggaaattttgtagatgaggtttagataaatgatgatcatgaacttatagtaagtaattatggattttgatatatgaatttatatttgattttggatttagatgctctaaatcaatattgatttaattatctgataaataaagaaattgaatcttttatttgatggattttggatgattatgttggattggcttcgtgttatcatgggctccatccttcggtagcatggtcgtgttatgtcccgaatttgaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattatgatataagtgattaggatattatagaataacatcagagcttaggtgtaagatcactgagattatgaagtgatatcaaaactttatgtatgatcaataggatatgacagagtaaagtatgatagataatatcagagcttaagattatgatcattaaggacgtgatagaatgatataaaatttaggttatgatcattagagaatatgacttaagtggtatttgagcttaaggttatcattattcaagatcgtgactttagtgatatttgaacttaaggctaagatcataaggaatatgatagatataaaagaaaggattcaataatttgatttcaaaccaataggtattatgatgaaatttatgcataagcagcatatgatgtctataatagaattgacaagttatatcttggatttcaattagtagggttgatctgagtacgagaagtgttaactctggaatgaagtgggaggtattgatatgttatgttgggtatatttgatgacattagaatgctaaacttatatggataaaggacatgataactttgctgattttgatgttaatttttttgcaaaaaaagataggttaggaagttgtttaaatgattgtaagataaatcaaaggttaactcaaattaattctagacatattggattcttgaggagtggtgaaacttatacaataagttcaaatatagaagatggatgaagatttaattttgatgtgctatgcctaagagatgtaatgacaagaaaactataaattttatcctaaattttatatgaaatctgaaagttggatctatctttgattgatttaacatataaagatatttttatttttgatagatttagataatttggtaagttgagatcagagtgcgcagcaaaagcatgatggtctgaattaattaaaaatattaatcttttaaattaaaagatattatgaaatacgttagttataaataaggaaggattttactgataataaaagaatgctagagagaaaatctatctgatcaaggaaagacttaaggcagcacaggacagacaaaagagttgggcagataaaaaaagaagagaattagaatttcagatcggtgatcatatttttctaaaagtatcacctacaaaaagtgtcatgagatttgggagacatggcaagctgagtcaacgatatattagaccttttgaaattttaagccgagtaggagatgttgctttcgtacttcacttaccattggatttatctaaagtgcacaatgtctttcatgtttcatcactgagaaaatttatacctgatccaaataatgtggtaaagtatgagccattgcaagttcataaagacttaacttatgaagagttttttctctgaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttaacatacatttaatgcctgcagtttcatttttttcatttaaaattttaaataaaaaaatatctttcttattctgaaaaaattatgacatcctgtgatgatattattatattctatggtctaattatgactttctggatacaagatgtcataaataaaagaaaaagatattttcatcatttaaaaattttataaatttttaatgatgaaaatattcttttctctttatgacttttgaaagaaaaattaagacattctgcatgtaaaaagtcataatttgatcacaggacgttataatatagctataagatgtcataatttttttagaagagaagaaatatttttgtcatctaaaatttaaaaaaaaaaatgaaactgcacgcattggaaagtaatgactacatgctctaatgtgattagatggtgtgctccatattaattttatcataccgcatgcggtcgcaaagaattagaaatgaagttcaaaccgctcagtagctgctatctcttccacgtgaatggagggctatgttatcatatagcatagcggcttccagcgccggagaatgtaaaaatactcggaaggctatgttatcttaacaaaccacttacggtagatatcctcatcaagataggaatggcaggcccaacttattgtcttccgtgttcaacccatcatgaaaccatagatcatctcatgactccatgtgaatactcctatctcacataaaaacatctgctacaactctcttcctcctccaaacttcacattatctttgactattggcacaattgtaggttgactgtctccaatcttcacataacagttgcatacaactctgcatttactactggctattggtgcatatggaaagagaggaaaaaccaaattttcaggtttgaagtctaggcttggcagtgtgtgttcaaccaaaaaccctgttgcgagattggtctttgtcatccagctatgtaaaggtcattgcttttgcctctcagcttcatctccgacagaaatttcatggctatagtctttgctccataactttgaaacctttgaagtcagataaactgagctgagctccatgttcatattttctcaaaagtgagattctcggtttaccttattgctttcttcgtagtcacatcataatctccactgattatgtgtttgattttgttggcttttgctaacatgtgggatactatccacatgggactcaccaaaagctatgtgttttggggttataatatgctcatgaatacatgctattgtaaagttaccttattaatgaaataagggtggcacacagcctcccattttacatactgaatatatatataggatggcccttccgttaaccgccatttcttctctcccacaacatctcccaacttttgtctccatttcttcaccttcagcctcaaaatgagaaacaaaagaaagaaagaaggacgagcttttccgatcatctgatcaagaaaaattgatgaaccactcttgaatcgaggttagtcctcttctattctttccattaattagagtttgtgttttgcttcaatttctttgatgcttggtgacaatggtaatttctttattgaggataatttctgattttcacacattgatttcattgatcttcaatagaatatttgtagattataataccagcaattacagtaattacaaaaaaaagaacatcttgattacatactcagtaaggccaaagaaccaaaagtagaattgctaaataaagagaaataaaaaataggtgtgtaggctaaatatgaatatatattgacttactaaacataaagaaaaaacaaataaaagtgtatgtcaaaagtagagtgatgaggtggaatgaatatgtgctgacacaccccctcaagatgaagaatcaggactacgaatcttcaacttgtcccttaggaacctaaaacgtgggtacccaaaggcttggtgagaatatcggcaagctgatcttggatggagatgaactgaacagatagttgatgtcatgcaatacgctcacgaacgaaatgaaaatcaatttcgacatgcttcatgcgagcatggaagacaggactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgggattataaattcggtagagggtattttgagattcttgatatggtgtctgctcaatttttattttttttatttttttggttttagtgctagttttcgatatctcaagggtcaagtctttttttttctgcattgaatggatgagattacttcgattttgtttaaaaattctatcggagactgaaatattatccaaatatatatatttttttaattttaccatttgcttgatgatcaaatttaaattcggataataaatatgatcataatattaaatgatggagaagataaatttttcttctgattaaggtttaaacttaatttaataccccctcgtgacagcctctaggctctttcctcaatttcttaacttattgttttttattcttctttaccttcttttaatatattttgatgtaaaattatttttatttgtcatgtcgctatatcatgtggtattttgtttctgctacgggcgtatgagacaaggacgggggaatggatgggtcccttcgctgtgagggctccaagccttccgtctccactacagtgtgtagtctgaactagtgaatacgttgttgtttgttaagtcccaatcacattgatacaacaatctttggagtttgagaaattggatgatgataataacagcgttcaaataatggtccctacaatggagtctacctcttgtagcaccaaccatgagaaaccatgaacagtagactctcctgtacatttgtagaccattatataggcagagattttatgagaaatttattgttaattattttatatcagaaaagagaagtaaatttagcttttggttggactacctagagaaataagcttgaatgtaatgtaggttggattgtttgttgtgcgaatgaccaactaatcaatcataatgacaaagctcatatcatatctactcttaaaggataaagcttccaccatttgcccttcgaaaaaaaaggataaagcttttactcatcatatttcagagaaaaaagaatgaattaacatgaaaactaggtccctccgaaaccctgaaaatcaacattagctcctatttaggagtgaggggccacaggcattgctcaaggcttcttttaagaaacggccaggatttgaatcctagccatagtagagatatcaaccaactaatctaataattattatcttgcttgtggcttccttgcgactaacaatatttgatatattacaattacagcatccataaactgcatgatatattaattatttcatttggacccaacctcttactttctaaaaaacaacaaactcatgtcacaatatcatggattgcaaccatatctttttcatgccaccttgccatgcgctcatcaattaagcatgccaatatcatcttagctaccaatttaattattaaacgaaccttgtcattgccgatcgagcagcacaacatcccaacttagaatttcagaaaaaataatcttagagatataagaaaagaatagttctatgacaatgattcttgctgcttagtttctccggttggcagaaagtatgcatggtatctttcatacatgctagagctatgcaaccaatgcttggtaagcacttgctgaatactttaattggcaaatgtctcctcccatataagattgtctgcccatggaggcctggaagaaaaacacatggcccctcgtcccaatcatcgattagtcttgtatgttgtatatcttgtagtgaaatgctttagatcggtattgcgacaaaggtgcctgatggagaaggatgtcaaagcacagaattctttaaaacattgatcaaatcaaagagagatagaagtcaactagctagccttgtttctattggttggcatctcccttcctaaagcttggtcatcaagatcaaggaccccttatatcgtagatacagtacccataagatatttgtatctgtccaagatccccatggcttgcatcggctttcgcataaattgtactcaaaaattgaaaaattatatcatgcactgtacataccatgtagcagtgcaccacaccaatcatatgctgcaattcttatgggatacatacatcatgcgtcatcttagactgccgtttgcacacctcatctcgatttattcctgcaatatactgctgatatggtgcttggtgcagaatataatttctccaaagaaaatgtgggagttaaaatgtacatggcctccaccaacatctgacacctctctctctctctctctccttcacatacaatggtagtatctctctctctctctctctctgagaagttcctctgatgttgtgtctcgctcgctcgtccaagtttaccacctgtttaaagagtttccatgcaatgttagtatctgccgggccatcaaacttcagcaccaaaaatctcggcctctaaaagatattgcccagttgcaaatagcgttagcggttggtaacacgttgacacaaagattgctcgtaagcgattagaagccaacgcaatccaccatatttctccattgccatttgccatttgcccacgtgatccttcctttattacgcggcagtaagcgtgacacaattcttcaccttcattggtcccaccgtaagatcccgattacatacggcaattgagttggattggatcaaattcagataagattaaaaaatcatccatccaaatcgaatctattcattaaacagatcaaaaattcagatatgaactcgatttatttattaaacaaataattcgatctgacttacttaatctatttattaaataaattaaattagattaaatagattaaacatgttacatagatcggattaaataggtcgaaaatagattaagcaaattttaaatagattaaatagattttaaatacgttaaatagattaaatggattaaacaagttatttaactcaatccaatctaaatattaaacgagttaaatgatttatatatctaaaactgaaattcgatccaaatattaaatagattaaatggatcgatctattcatgatccaaatctgtttagtctaaattcaaatctatttgtaacggatcgaacatgagtcagattaatagatcaagttatattttattggaccctaattttgatgcatggaacatttagtgtgacgtcaaatagtgcaccaagcttgatttaaaaaaataaataaatgcacttataagaaagaggcagagagagtgtgtgtgtctgagggatggcagtttggttcgatccgttggatatctgatctgatctgattcgaatgaggcagattttaccgaacccgattgaaatccgaggtagatatgggttttaaaaaaaaaatccaaagcggatataggttgggtatgggtaatagtatgccccaccctgaatccgatccgatatatatatacacacacactcaaatactcaatacaaaatcctagccatctaagcttcctgtatttggccactctgtctcctctaagcttccatatttggccactccaagccttccacccaattgggactcttgaggttgggaaaagcaggaaaaaaattaggagaagatgaaagaaaaataaaaaataaataaagaaaaaatgaaaaaatttgagaggtaagtcctttttctatatatattatttttttttattttttcttttcttttcattattttttcagagatctgcaggaaaggagagcacttgaaagagattaaaggggtttttgaagttccgattgaatttttttgcctcaagtatatgggattctatctgagctgtagcagtgtgagttggttccttgaggttttgaaagcttaatcttggtagaagcataatattttgtagaattagagttttttgattgaaaagaatttttttttggctacaagatttttaatttatagggctttgcttcgttacataatttttttaaaaaaattatataaaaatttcggatatatccaatccgatccgatctgacccaattcattcttgaagctcgacccggtccaactcgaatcgagatgggtaaggagcgggtatggatatggaattttggctagtaaggcagttatggatattgatcaatccgatccatatatgcccgttgtcacccttgtttatttatggataggtttcttaattcaaaatattcaaagataagtatggtaagtaatgattcggatataattgagtttcttaattcaaaatattcaaagataaatatgataagtcacaatttgaatataattgcatcgttataaattatttacctcatataagcaacaggaccgaaaaaaaaaaaaaagttacgttttgtgtacgggtagaagaaaagggaagttaaaagagaatggagggaggagaggagaaggacatggcgagcagcaagggaggggcgatggcattgccggcgagagaagaaggtgatgggggacatggaggagcaggaggggagaaggaggacatggagatggggatgagagagccgtttctgagaaggcgcaccatgaacaccgcctcccagctcgccgtcgtcggcgcccacgtcagccccattgagagcttggactacgagtaagccatcgatgacgatccctttccctcctatgaatcatgtctttgtgtttgtcgatgaatatgaaacatgagaacccacggtcttatgaattattatgcattgccgcattactccgaacgatctttagcagttattttttcgatataatctcaatgctacagactctttagtttatgtccaatgctattgagcctagtaaattatcgaagttatctataatgatgtgggatgacaacatgactattgtgtttatatctgattcttttgcatgatgatactcccatgcaattgcaagagaagcatctaaccaattctgtatatgctttcttcttgtcccgttattatgaatttattattgttatcgatagctagttactctgttattgatggattgtagtggctgatgttccttacttttggttcctgatcatcaggaacctatagaatcctgttttaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctcccacttaacagtgcaatttattagttggattcttggcatgaccaccttgtagaaacacaatcatatgccaatactactgccgctggttaaagtctattggaatatccactaagcatgattgggcactgtgtactgtggaacccaaatgaacgcaaatatttgttatcatttgattagttgaaaaagtatgagcatctcaggaatttgaagaagctgatcttttgctcatctcaaacattagaagtaagaagtcataaacactttctcaactgtaaggattaatgtgttgcatacacataaacatatgaatgaatgtcataaactatccacaaactaatgttccataatttgattagtcttttcttttttctctctcttttgataaaaaataataatggggcacaaccaataacttcaaagacaatattggtgaattacgcaggtcaattactgtacataacttggcagtcaaacaacagattgtaatcatttaacattgtaaaggcaaaagacaagttataataattgaaagcttccaaatgcacgtaatcttatccattgtaatggaattgaaatttactgcttgataaatagcattcacatctgtacaataagtccaattaaatactatgtgatctcaatgcaggcaccgtgaagcatttttggcatatgctggttgtaatttaatattagctgcagcagctgcagccttatgtgcttacattgctccagcggctgctggatctggcatacctgaagtgaaagcttatcttaatggtatcgatgctcactctatattggctcccagcacactgtttgtgaaggttattccagtccttaccttttatttgtcttatgtttctcatgccaccatcaatgcagaaatatgatacaaataaggatacgagttaaatgcaatgcacataagcatccaatatctgtttttatctttatacagtacataagaaaagaaatttataacacagaattagcatgcaaatcttcctgtccgtcagatctccttaacactagttagtgatcattcacaaaataagttgtttatgtgacctctcagtacttttagaggtccatttcatcattagcacatatggccagttcaccaaagaggtcatggtcatcataattgggacctggcagtggtcagatttgaacttcacttggtcacctgcccaacctaatcgacaaaagaatatgttgggttaccaattgcttccttacaattttcctgccttctcagtttaacccatctccaccatgcttagttgtcttccttctgtaatgaccacacatgaagcactccagaccatcaataacctttttgtctgtcccagaacctccatgttgacagaggcctcataataaattctacaatatgctcaaaacagtagttacatctgctcttcctatcatggaccgaaaaattgtcagcataaagacatattaaggatttaatactcttaactgttattgctactttcatcatatggacatctaggtcagtttatatttaatttgcatgaaattataagcacaatctcgtttatttagcaagctattcaaacttgtccttatactttgaatatatttattatttgcaacttggccaaggatcagaaagattttcaaactttgtagtacctcaagtcatttagtttctccatgtcatcacacactaggattttgggtctggtaataatctaaaaagcttattttcttttaaggatcctcatggctggctgttgtctgctggcattatcctaccttcaaaggctttaattttggagtgtatttgatgcactgatctacagatatttggttccatttgtggagtctctgctggatttgtgttgggtaaggaggggcctatggtgcacacaggagcatgtattgcaaattttcttggtcagggtggatctcgcaagtatcatctgacatggacatggctcagattcttcaaaaatgatagggatcgacgagacttgatcacttgtggggctgctgcaggtgtggcaactgccttccgagcacctgtcggtggggtcctatttgcccttgaagaggcagcctcttggtatcatcctaatgcttttattttttatttttattctcatattcttctttcatatctttgcattcagttgaactctggttcttcaagggaaaaaaaaatcatattttttaggagttttttatcaccaaacagaaaaagatggttcaagaaaatcccagcaaatacagtttttctgaaacaatcataagatacagaaggcgtctattataaactcaaaataatgatcctatgacattgttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccgaaaagaggaggaaatggctcgaccgaacagggtagaacagggtctcgccttttcatcaatttttccaacgatcccgacggccgacgagggtgcacgaagccatgggaaggaggggaaggaggagaggaaggagggccggggcttaccttcgacttcggtgaggtttccggcgagaaattgaggtgaacacaaaaacagggtcgagagcttcaacggagaattccagaagaagaaagagggagatctcacggctggtcgaggctggcttttgagggggagaaggggatttatagggctcttttcaggggttttcgatggccccggggagttcttctcctgatcggtcttagggaagaagaagactcccgttgggagtcttcatccttctttttttttttttttgatgggctttgtgggctttttggcccaacaggccggattatcacagttacatagttacatacatgcagcgcttataagtacgtccaatgcaatggatggatagatgacagagaatgattcatttcatctgtttttaaggagaaaatgatacatttcatattgaactagcttctagctataatgcacctgccaacgcatgtgaatcctgaagaattcagattcgaggaaatttaactgaagtctgaattctaataagatgtgaaaataatgaattagtattttaatgcattttttagaagttaatgctttaaatctctagatatactgagatatcacttttaccagtttttcatttcttttttttgctaaattaaattttctggtttaaaagttagcatgagttggtttgttccttcattctatatctactcatttttttcattctcaaagtccagcaacattataattccttcttttatgaagtctagcatgttttaaacctttcgagaggaaaatttaactagctttacatttgaaatgttttatatctttaacagagtatcctgataaaggtaatttttgaaattggaaaatttggaaatcaagccacttttatacagttttatctttaaatatacatatatatcattgccaactacagtgcaaaattttctacaaatctacttcataagatctaagctataaattggtatttcatagaccctgtactgtttatccacgttggagagagtatctaagcctagttagcagagtgtattataaattttaactgtttttctttgatcatttaggtggcgaagtgctcttctttggagaacatttttcacaacagccgtggttgctgtcacactgagagctttcggggagtactgccggagtggaaaatgcgggctctttggaggaggaggattgataatgtttgatctgagttcaactgctacctcctatagcacaccagatcttattgcagttgtatttgttggagccattgggggtatatttggaagtctatacaactttctcgtggacaaggtcctttgcacatatagcattataaatgagtatgtctcaatactgcttagctggttgttgtcattcttggattgtgttgatatactctagacattagcttaaatcttctctcattgccaaagattttagttgcactccattcttgttctccatgctgtttctgacagggtctaattatttgcaggaaaggtgcacctttcaagatccttctgacagtcaccatctctctcttgacatcatgctgctcctatggactcccttggctagccaaatgcaccccatgtcctcttggtctccatgagcactgtcctaccgttggccgctcaggcaacttcaagaactttcaatgcccacaaggtcattacaatgaccttgcttctctcttcctgaataccagtggtgatgccattcgcattctcttcagcagtggcactgacaatgagttctatatttcgtctctcttcgtttttttcactgccatatatttccttggcattgtaacctatggcattgctgtaccttctggtctcttcatccctgtcatacttgctggtgcctcctatggtcgcctggtaggttctcttcttggcaccatatgtggcctagataagggcctctttgcccttcttggtgctgcttcttttcttggagggactatgaggatgactgtctcagtttgtgttatactccttgagctcaccaatgaccttccaatgctcccgttggtgatgctagttctcctcatctccaaaactgtagcagatggtttcaacagaggggtctatgatcagattatcataatgaagggcttgccttacatggaggcccatgctgaaccttacatgacaaacttggttgctgggaatgtagtctcaggcccactcattaccttttccagcgtcgaacgggtggcaaatataatgcatgcactgaaggtaactggacataatggatttccagtggttgatgagccacccttttcagatgcaccagagttgtgtggccttgttttgaggtctcatttgcttgtgctgctgaaaggcaagacatttactaaggacagggttttaactggtccggcggaggtttatcaaaggttcggtgccttcgactttgccaaagctgggtctgggaaggagttgaagtttgaggacttggccattgatgaagaggagatggaaatgtatgtagatctccacccagttatgaataggtccccatacacagttattgaaacaatgtctctagccaaggctgcagtgctcttcagagagcttggactaagacacctatgtgttgtgccaaaaacaccaggggtaagaattctttcctccttatttctaattctggactttgttgcgcttacattatgccaatacctgatatcagcctaagtgatcatatatttgaatgtgcaagagcaattttcttgatctatgttctgcttatattctcaagtgagatagtaaataaatattttgtgataaagtttttgtaatttctgacctcttaaattctgaagtcaaaatttttcagcattttcttgattatgttaatttatattgtggatggtgatgattgcattctaacttgatcagttcagattttggactttgtccaatctttataaataaataaattaaaaaaaaattgatcagtttagatatgtagaaacgttgaccaacacaaacaaacaatctttacaataaaatataccatgcgagtgtccctgtcttcttacactgtttgactgtgaccaaggttgttcatgggctctagttcataaaccaatcgatatggcaatgggtcgggtttggttggtttcgcatcaagtcaagttaggacaccaacatacaaaaccttagcctatacccaacctcacccaacatctggtgaatacttcttgatgcatacccactcatgggtaatttttggtcacctatttgaccctagcctgatctattttgaaatttgatacctaataactctacactaacctaccaaatccaatatttataattcttaccggttaatttccaaatttaaacaactagtgttgagaaaaagactaattatagaaaagatcttatccaagatcatgactcaaccgaacttaaaatattttgaccaaatagagctctaatccgatgaccgaagtcaggtcaaagttttgacccatgcaggaatagttcaggtcagaaaatctaacccatattttaactaaaaaaatcttgacccaaacccgagccagatgcgaaaagatgtaaaacaaaatgttaatggtgaaaaataaattgagcttgtacaccattgaactcttaataccatgctaatctgccctgtgggaacaattggctttttgggtttggattaagccgaattgatatatacctagcttaaatgctactcattctccttcaagttgtttaggttataatagatataggaattgtagtgctatcttatttttgaagtttttcttgcccaaacatgccttgttaaatgaagtgtcaatgctcttatgaaacctgaaatctgttttcttgcagaggcctcccattattgggattttgacacgacatgacttcatgccagagcacattctaggactgtttcctcaactcaagcatcaaaattaaccatacagcattggtgtgacattcttttccttgatctaattgctattgctgctacacttaaaatttgagttttagcattgttaccatccttaattaccatttttttttctggaaggttggtgaagatctaagcttggagctgcagatttattattagagaaatcaacatcaaatctcaaatgtattccaagctacatttctctttgtaacatgttttgcaatatattgttgatgtgaatttgacattctgctgctccagagctcgaacctgtacagttgatgtgaatttgacattctgacagtagttacatattgggagaacatgatattctctcggagaaattgttttaatagggttgtatatataattgaagaagggaactacatattcaaagattctaaatattttcccatgttagccttgaggatacatgattgggttttgacctacaggtagaacaagaaaacaggtcatctatttagctcaagaactttgttacttttctagccagtcatggccatatcaaaaggaccaacaagccttgtccagtttctccaagtctcttctcacagcttccatagagttttcacagctctctttggaaattgtttcacaaaccaaaccatttaaactagtattttgattgttaagctttttaagcagtttagttatcaggatgctaagatgttgacaagtaatattattactgtcatggtggcagaaaaatattaggatggactcttgatatgctttttttttttttttttggtaagatatgctttttgtttaacaaattttcatggtgctagcaattggagggcattggtgaatagtggacttttgttaaactatctactttgaagactttcagatggaattgtatatagtgctttatgtttttgtttactttggtgccttttacctgattttttggtccctaacttggatgatatttggattttaacaaatctttacatatcaaaacgaaggagaagggggtgattccatcttataagatgcatcagttaatattattattttcttggaaataataaagttttcttttaacacagtcagcattactctagcacaaattaattagctgcatgggaactgaaacttgggtttccctgtgattttagcgtttgttttataattgaagatatatttgaatcaagacttgcaagcaaaaaaaaaacaagaaaatttcttgtcaatatactggttaacagttctatggctaataaatctccagcccggtgattctctaatactgtacaaaaatcttacaggctatttttatttttttttctactgttgactcattgctcaaatccattgaagaatatctaagcagttggtacatagaatagaatgatagataaaggatctcaacaaggcgcaacttcgccagctagaatcagcactttgttggaatgacaaaaaaaaagtgaaggaattttatcaatgaccatgcttgagaaagtattttgttttcattggcctcagcaaaaaggaaaaaagtttcataagagaaagatggcaagcttactgcttcatttcgataagataatcaaatcaggtgtaacaaaattagaattaagcattaaaaaaaaaaaagtctgcctaaacttttggatatctttttcctttttcttcttttaagctatcaaagagccccctccacagagtttgttgaggctttgagaatccagcatcaagcaccttccagattctccaccagatagctgcatgatatttcttgttgtttctgcttattgcctaaactcctcaaaagggcaaaattttgcctgggcaacaaaattgacaaagtgtttttttctttctttttttttttttttttttttttttaaggacaacaaattacaaggtagaactagcaaaaatgactcgacgactgccaaccttctcagctaagaaagcaatgttttttaccgccctaatttgccagaatcaacatattcttttatattacttcccatgccacatgtatctcaagaattgaaaacaaaaattggcgtcaaagtcatgcatttccaggtatttagatccggaacggtggcaggcactgccatccatcaattagaatttacttgatgacaatcaggaggtaagagtcatatagaaaatgactcaaatccaagaaaactaaaagcatatttgattcatgatcgaaattagaatcagaatcgaaatgaaaatcagaatggccgtatcacttaaagcatttggttagaggttagaattgaaatcgaaataaaaatgatatttgaataatagaagaaaataaggattagattttgagagattaagatatttctattttttttgggaatcagaatgataataaattttttctaaccaaatgattgaaatgaaagccacacattcttattcctatttcagctcctttcagagtccaactttttccaaccaaacatgccttataggagcaaggcagagagaaattcagtgactagaactcccccatggaagaagaaagaatctattcctgagagccaaatacagtgaaaaagatactccattccattgaagcctcaccttcacccaagcccttcatctctcctctcaaacacccatatctctcctcccgttttgctgctttcctccaaaagtacaacttcatcatttagtaaattgcagctttgtctagaaacctgatctccagccctggcacatgatgtaatgaaggggtgcaccatgcaagagtgataccaactaattgactattttagagagagtaagcttaagtgagaaagtctcttgactaaaaagatgagggttagggtttcttttactgtggctttctgagggtcatcggagccttttgacccacaatggagcttgatcctaaggggtccaactgaacaagtctctcatgactaatcttcatgaggattcgaaaaggaaggcagagttgtcttcatcgtcttgatattttactacttctactggtccaccatcgactgattctacttattcttgggctcaggtggtgcagagcatcagaagattttgataggatactcccaaggcttccttagaagagcttgtatctcttcaagaaagattcaaagaggtggtcactttactaatgaagaattggatcctatctattctaaatggaaaactactccaatcaataagccctttgattgtagtttatctcttgacttcatttagaaagatctgtgagccaggtggggcttgggggagcacctccaagtcgtgccactcttagatgaagtttacttatttaagtttccttcagaggaagtttgtgatcaaatttttgctcgtggtccctttcctttggccaattaacttatagctctccaagaatgatgatctaattttagaccaggtagaaatactattaatcaagtagccatttggttgtggatgcctgacttgcccataaaattttgagagaaggataaaatcctctacattatctgaatgacaggtggatggttgtttcttaatgatgagacctcttcagcttctcaagctagatttgctagggtttgtatccaattagatttagattgtagcatctatcttggacttatattatgttaaagagaattctatttgctaagagtttgtttataaagagttaccgaatctctgctagccatgtaaccatttcagacatctctatgcttcctgtaaaaatcatgaactggatagctccttgcccaagcctattttgggaacttggatcgatacaacttgactcccaatgacagagccttccactgctactaccagatcatcgtctattggtgttgctctttttgtgtttcaagcttcgactagatcttcttccaataaagcccaaagtactccacaaacttagccatcctcatctaccacttaggtctttaaggaagttcatgtattggaggggtcacggtttgttcctttagctcattgcgtagttgaaatagaacttaaaactatggaggaaatcgactcatccaaattctctgctattccatccttggtgtccaaatccaaaatgaagaggaagagatctcctccaaagactctaaaaaattcaacagatcaaatgatttgattcacccacttaaactaaagtaaagactgcaaaggagggtgctgctactgaagaacctgctttatcacccaaactgctgcttcttttatacatgtttctatgcagtctgtgccatccatggagcaaggatagtgtaatgtcgatcctgatcttacccattctttaactgcttcttctttattttcttctaaggccaataacccaaactctcgtaccattttctttggtcagttacaagttgagttgggcctagaacacaccttgattgagcagtatgtcattacaattgcttctctgaagcttttagtgcccagactcaatctcaaataagctctataggggcgtctgtttccatatcttagtatgaaaatattattatgaaattgtcggaatgctgctaagcaccccttttgtttattatataaaaaatctaatacatatgcattgtctagatatttgttgtatcctagaaatatatttgtctaatgcatctctactaaaaattcaatacatactaggttcttcttggcagctatttatcatgctagttattattctgaggatattctgatcttttggcacaagagtttgggatgtctaagcttttttatttctaatcatcaactgtttgtggtgttattacacctgcttcatatttttattaactatttggtacaatttatactagccagtatgaatggtatttagtgtaggccagtttggcattcagttttggttgttttatcattagctttacctactttgcttgtggaggattttaattgcaatccaagtgctaatgaaaagaaatgaggcagatttttttgtttaaaacaagatatagggagttttgatcttttcttcaacatataagtttgattgatttgggttttcaaagacctatgtttacctggtgtaataatcaactaggatctaatagagtataagaatgccttgatagggctttggctaatgttcaataggttgattcattttctgagctcatggccggtcattttgcttctaatcattgtccttcattgattctgtttctaatacttataattataggcctaaacctttttggtttgagaaattttgactctccgagcacatatttatgatgttattcggcaagcttagcactacacaaggaaccattcttctggtgtgcgactttctattgttctacataacaccaaattaggccttagttgatgaaatcattgtcacttaggtaacttttttcaagttggtgaagtccttaataataagttggagtatcttcagttgaaggaagtctcttatagtggtttgcctcattaagatcataaggatttactgcacacccttaggctttataatcttgacttgaatcaataagaaatcttctggcaacaaaagtctagaatttcgtggcttaaggaagaaaatagtagtactaaattttttcgctactctactatacagaagagaagagctactaaaattactaaattttagtcattagatggatctaaagttgacgacgatgttatgattcatcaatttgtattcacttattttaagcttaaatgaacttagcagattgagccactttttgattggttatgtttggtattacccattttatcttctactcaacatgagcaactagtatgcgcagtcactaacaatgaaattaaggaagttgtcaaacaaataaattatgatcgctttctggacctaatagatttcctcctctctctttttttaaggtttttggcctctaattaaatctgatgttgttcttattgtgaaggatacttcacaatatatatctatgccatggtcttggaaacaaacttttattacttgaatctcaaaaaagaataatcttattttaatttttgatccattaatttgtgtaatacaacttaatcattgcaaatttttttacaaacaaactacttatcatgtcttccttaatccatcctgtgcaaggtgccttttttcctacatataaaattacagaatatgttttgattacccaaaagattatgcattccttgatgcatgcacctgtaactcaaagtttaatggcactcaagattgatatgaaaaaaacttttgatcaagttaattgagtatccctcttttgtgctttacaccattttggctttcaacttggattcataaagtgggtacaactccgtgtcaactttattaataaatgataagctatcttcttggtatcaaactactatgggcttaacacaagggtgtccattatctctttatctatttatttgtattcttatatattatctaatatactctagctaccagtaaaaagttaggcccttagagcatataaatcggctagaaatgatccaactcttgctcatattttttctaatttatattgtgctttgtctgaatagattgttaatgcaaataagtcacacattatttttagtccatccactaatgttgtcacaatacaataaatccaccacctaatgcatatgtctttaaaatatgatacttggttatacctgagtgttccccttttagggattagattgaaataatgtgattttacctatttaatagattagatagaagataaaattgagagctggcaatggaagactctttcatttgcatgaagagcaatcttaatgcaatcgatcttaacttctatccccatgtatacaatgattttccttcatttcccttcctccattctacatatattagagaagtacttttgtgccttcttatagggacactctattgattggcatggtctacacgttcttgctcagagtattgtttgtgcctccaaatcaaaaggtcgttttggtatttattctttatgattaaagtagaagtatatgctggagaaacttgttgctcaacttatcttgcaaccccactttctttgggtttaattggtcagatctaagtatcattttcagggatcttgaggtatgtactctcctcttcaataatgttcctccatttggccagggatttcttcttctgcttgctctattgcatatcaatttcagtgggttttatctgctgatactcaggttcagtttgtatttgacccatagatttctatcccattagttgcatcgcttacttgtcttaatattcaggtcgatatcaggaggttcagcttgttaagtttattacacctgatcactcatgagatatggcaatcctggccactatgtttctagctaacatggtctccttgatactagatattcttatagctgctggatctagacttgattagttatgttggagtgctataggggctactcagtctctttgcataatgtttcagctaccatatcctcttctacctcatcagttgtgcctacattttatactatttggagactttcgatttgtatgaatgtcaagactttttgttggaaaccgatttggttgaagctcccgaccaaagaatatctatttcatactcatactctaccacatctaattacttgttttgatttatatcatgacaggaaggaggatttacagtatatttttctcagttgcaagctttcactcctttgttggacacatgtagtccaagtaatgcaatgtagccctcaactccaatctttgctggtattaatctcaaagttgattgttgttttggcagagagatgagttggggctataatggctcacaccttgtggttattttggctataatggcaagaatgggattgttggtaaattctataactcaaattcttcaatatggagaattaaaaggcctagagctagcaatcaagatgctttgtaggaatttgacaacttacatcggatacttgctcaagtttcacctcttcaatgtagagatgaagtggcatggaagttggaatcaaaaggatccttcactactactttatataacttcattaatactagagggatcaaatataagtttgctaactctctttgggacctttgtgtgcctctcaaattaagttaaatgttttctttggctttactggaagaaaaaaattaaatacccaagaacttcttcggaagaagactggaaaaaatctaggtggttgtgtgctttgtggccatggagaagagtcagttgatcatttattctcaacttgttttttcttctcatccatctagaaagctgtttgttccttacttgggatactacaccgacagtcttcctttgaggatcaatgtctttcatggagaagaaggaccttctcaaaatatttacaaccaattattttgatgctatactctgccttcatttgggtcactggaatgaaaggaatcaaagaatttttctcaacaaaagttcatcgatccactccactgctatgaaaggactcaccttgttcaacgaatggtctatcctatataatcataagctactacctccttttggaaagatttgggacaaggttcgacatcttccaaggatgcttgctgatgactgatatggtgaacaatgcaaacaaatgagatatttatgtcccagtacccatcaacgactgttgaaacatgaaggggcaaatggatatgacattaccacttatgcagatgggttctctaacccaccttaatcagcatttttttttttgatagaagagaaggtattactacccattattattaataattagagtagttggttgaccaaggtcaaccagaaaaggacatagttttaggctggcggttttacaggttttgcagatttttagattttctagtgtcgtttacagattttcagatgaaaaattcagaatagccttacaggtttacgtgacttcagtaaactaaaaacagtttgcagctatccaaaaagcgaaccaaatgggatgagaacaacatctttagtttctctattcaatagtttcgatcccaaggcagctagtaaagctgttgaatcattttttgaatactggatttgtgcttatcctcagtgattgcagaccagctagtgagcatttgaataattcttagaatcagggtctttgctgttagagcttcaaacttgaacagccttctattcttttccttgcagatcaactaacagatggttgagacgatggtgtcccaagattgtctatgaattattgttggaagacgatcatgccagcttttccaaatatcttcagccgaagatgaggtatacaaaatacctagcttttgagtgattctctaccaaatggattcagcatagatgcagatggtgaaaagatggcttatggattctggatgtaaacaacacattggacaaacatgagatgtccgaacattccttctttgaagagtttctgtagtaaggattttgttgttttgcagcaaccaagtaaaaattttaattttttcagaataggtgggtactagattttctttgcaaagatagacctgatactgccgtcactgaagaattgataatattttctaacagagaattttctgcttgcactccattttcaattggcattatatgatgtctccaagagagttatactgacaacatttctattgaaactttaaaagatttcctccatgttcaaagatatatcttccctgaaagtcatctcaatattctgaattcttttgaattcatgaacagatagaagttgaatggagaaaagatgaaaaagaattgaaaaattggatttcagtggcataattccaagccattggtcatccaaaatgagatattggttccattgcccagattaaaataaatgctttgatggaagatcatgcctgttttcaccacattttttcaggctatagagacctatttcggagcccttccttttgttctgtttagcagtctgttatgatagtgcggctgtgaatgaggatcttctatgtcgcattgtgtttttggtaaaatctccatcatcatttttgtaacagacacaagttcaagagcttgagatttaagacccccaagcccccaaagagttttggtctgcacacctatctccaattgactacagtgtataccttcgcagtggtcatctcccctccacagaaagctcctgctttttctatcaatgacttcttgaaggattagtaaggaagacatctaatatattggtatcctactgagaacgtgattaataagagttagaggaccccctagagataaaactttacctttccaagcagcaagccttctcttaatcttttcttcaaaaaattttcagtcgcttacagctgatttacggtggataagtggaagtcccaggtaagtagtgggcaatgttgatagcttacaaccaataatttacataataatatcactttctccttctgaagtttccagggtgaagagattattttttttgaaattgatgtttaaccctgatacaagctcaaaggagtagagaataaatttcagagtggaggcatgttgtcgacttgcattgcacaagaggagagtgtcatctgcatattgaatgcacataatttttttttgataatttcatttgttccgatccctgagatgaggttgtttgaggatttcgtgaagtagactgataggtctatagtcacttacttatttgcatttagatttttttgagaccaaggtagcgtaagagtagttcaatctgtgcagatctgttttattactgtatacatctgaaaaaaaaaaaaaatctgatcaggtctaccttgattgtatcccaaaagtgctggtaaaatgatattggaaatccctctggtcctggtgatttatacttggccatactgaaaagggcgtttttaatttctgtttcagagaacggagcttcgaggtcacctaggttctcaagaggttccgggtataatacttcccagttcatgtgataatccggcccaattgggcccaaaaccagcccacaaagcccaccagaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaggaatccaagcttgaagatcggcatagcaagctgaaaaaatttggcaacagaagtttaatttattttataatcatggatttgtagttattcataaatgttgagattcgggttagtacttacttttggatttagatgctctgaacccatattggttcgattatttgataaataatagaattgaatctttttatttgacagatattaggtgattatgataggattggcttcgtgttatcgtgggctccatccctcggtagcatggccgtgttatgtcccagatttggggcgtgacagttcagttcagttgaatgagagatttttcctaagtgccgagtaaacttgaatagtatttcagaaaggtgtctttaatttggtgtagattgccgatgatcctcccttggtcctctatccaagcgatcgtattttttctttttctggcacttactgttatatgaaaaaatttggtatttttgtccgcatattttaaccaatttgctctggatctctgcttccagtgaatctcttcttgatggagaacttgctctgattccaacttaaacttctctctttggctcttctcctcgtttgagagatggttgctgtcctccttgatgtcaagttactgaatttgattcgtgatctcatcttttttttttttttttgatgatgtttccatttgctgatcgattctattattttagtctagctctgagcaacctcaatttgctaaccaggtttgaagctgcattatgatttttgaagctggtgttccaccattgtttcatcatgtcggcaaactcaccttaatcaggtttcttgacaagctgaatactaccaggcaagtgaagctaacaatacccaattcatcctgaggtctaatttgtggaagcaccctcacaaccttgagatcgtgactggccttttcttctctttgtaatctaatttgatgtatcttctggatcatcactcccatcttttctattacttttccgcctttactttgtggatcaacactttgtttatgctgagcaaccttctgtaaataccttagacttcaataaaaaccggatggcagaattctacagcctcccttatcctcaaacaaaaaaaaaaatgaagaaaggctagcagggaatgatcatatctttgaaggtattattacttctcaccagttgctccatgagcattattgttttctccatgatagctcttacacttacgtctctcatgctttgataactatataaacatactgggatagctcagcttttttattttttacatcaccattctttccctctgttagatggcttccccctcactttgcagtagtcaaaataatttttgatagcttagttaagcaaggaactgctacagatgcttatcttgtatgagatcatttgggtgaacctttaaaatgcagccactatcagaataaataaaacttctactcctattgcaggttggtacttgggctagtctcaaaactacaatacattgcttaaaaagggattagattttcttaggaggatattcaaccactatcatttcttggattaactcaccctgactatcaaaatgtgcaggacatccactcttaagtgatattctccaatggaaacagattcttacagtctttactacaactcatattctgcgaaatccaacagattgactagctggccatgcttgtgacttcaatcctttggatcctatttctttggaattgaaaatgcttttataagctgatatagtgggagtcaattattatcggggagattagttatggattattctttatctttgccctttgttttttcttttttttccatagatctttatatctttctaagataaatcatgcagtgcttcttttgatttttagccctaatctcctatgtcagtttgttgcatgttttagctctacgggcttcaccaaatattagtttttttgcaagctgcaccttgtctttcactctatatgccaaagatattgcctttttaatgactatattcatagctttcattatatttcttctactccttgcaatccactctttattgcagatgggctgcgtgttatggaatatatattgcagatggttccttctactatttcggattctgattttcaattgccaatgttcttgcaaagcggcccgacttcaagcttattgtgttcttcgttgctgctatgccactggcctaattgctgatgttctgtgctgctatgatgctatgcatttgttttgtgctgttgttttctgtatccacgtagctgtcatgtttcttgtattgttctaacgacctgcttcccatgctgtgctattacatggtcctaattttacctaatttatgttcgttatactttcagcatatttcagctacagatcttattcatccagttctttatttcagtacttctgctttctatctcatattttagcactccgcattataccaaatcagcttgacaatcgttcgacatttattcttattgcgctgttgagcaacttgtctcatatttatcttgctgcactgttatgtatattatttctctaacatactatgttcccgagtgttttcggattgcttgttttttatttctgtttttaaccttagcttttcttttgtatcaacatgggagtgggagtcctgcaacgcaactaccagaggattttttttttttgggtggtgggggttgggtggaattccgttcctattatttacccaaaaaaaataaaaattaaaaattaaaaaaattataaggaaaaaaaaaagaaaaaagaaaaagaggggtgcacatcttacctcctgtaccatgagatccggcagctgtgattgctcggaatcgtcccggcattgtatcttgctgttgagatttgaacagcccaagcaagccctacagaacatattgtcggttggtcccgcttgccaacgaatgtataggtgacacgcaatccgaggtggccgtgggaatggtggacagctaagcccgagtccatttacccaccaccccattcccctttcttcttcccttgaacgggaaaaaacaaaatacccgcctccattccccgtctccccacctttctctctctctctctctcaaatcgtaaagctagagagggaggggagtttgggagcaggggaacgagggaagatgggggaagcgagagaaggggagggggaggaaattggaaacaaaggtggtggtggtggcggtggtggtggagggggactgggggtggtgagggtgttggtggtggatgactcccccgtggacagaaaggtggtggagatgctgctcaaaaagagtggggaaatgtttgaaggtaagataaggtgttctctgtttcatagtgatctccttttttcttttttcttttttccttaatggttgtttttgttgttgctatggcgtcgcattgaattatttatatgtttaacgctgttattcttgttgcatttttttttaatcgttgaggcaattgtattctttagcgggtgaaataaattggaagttttgattttttgtgtttcattgctatttgtggaattaaatggatggaattcttgtatttccacttctttttgaatgtccattggtgcacaacgatatgtctttcgttgtttgctggttgggtttctaccttccaattattttacaatttttccttctttagttcgttttgtgtttggtttggaatttggactaatttttagcttatctagtgtcatcattctacgtttacatgtatgcactggcactattctcttaaatcataattcatagttgtctctttcggattgtttcattacattttcgctctcggtcttgtggtaatcttatcttctgcaggatgttaaaaacgctgagatgtaaatgagttgaacttatgaaactccattgattaaatgtcatcctaagtcatgttattctataagttggttcatttcatgatacttgatctacctcctttatgattgtatggcctagtccaattattttgactattgtcagagtgcctctgtgatgtctaattgctctctctctctctctctctctctgtatgtgtgtgtgcgcgcgtgcgcgcgcgcatgcaatccatggcccttcccctttttttttaaaaccacaaagtggtatattttgatattggtttagtacacttgtgatctgcttgttatgcagacaaagaagatggaccatggagactgttccctctctttcccctattcatgttcgataaggtattatcttagacatgatgggacctctgacaaggcaatagttatttatctgtcatcccatttggtggttctgtcagattaaacacctttttagatactgtttccttttttgtttatgacagttatgttcttatgcttctccatgtgaccatcattctttcttaattagattctgtctataaagcatggatacggatgtgacacgatacagatgtgccgatgtgacaagtttggagaagtatgttacaacatggccatgagtcggacagcgtgagtctggcttgagccagcttgaatacaaggtgaatcaggcttggctcgaagttagcttgaacttgtttctcaagctcaaaatcaacaataattaaacctaaaaaagagaataaaatgaacagctcgaataggcttcacattataagtcttgaagtagggcatagaacatatgttttaaagagtgatagcacgtattatttgataaacatagagtgataatacattgatagtatattaagtagttctatttcgacatttatgattcataattaagtttggcttgcagtgttttcaactattagaatcaagttagtttttgttcaagctggaaccagcttgaatcaaattcataccaagcttggttgaagtttgataagagcttgaattaattttggattggtttgtttattaagctgatggagataaactcgtgtttcagcttgatttgaaactaggctcaatttaagcttgaataacaattgagtggagcttgatttcaaaatttaggctcaaaattaatttgaagttgagcttgaccagacccaggcttgattaacgtcagttaatcacaagccctactgcagcttattttctgctgctatttttgctactccactgctatcttcttctatgattagtatatcccagtgtcatagaataatgaatttcttgtgtttcagctcattgcagttttaatttgatcggtacttgtttctccacttacatgcttctttccatttgaagggtttcattggatttggtttcctttctcacttgtactacttgactttcgaccatctgttaacatggagactcatatgattttaatgatgcattataaagccgaagaagccatgattcttgtggttcattcatttttaatgatgaaattatttcattggttgcactgatgtcaattgcttttgagctctgactgatattcttatttctatttgaagggtttcattggatttggtttcctttctgctgtcacttgtactacttgactttcgatcatttgttaacgtggagactgatatgagttttaatgatgcattgtaaagccaaagaagccatggattcttgtggttcattcatctttaatgatgaaattacttcattgattgtgctgacgtcaatttcttttgagctctgactaggtgcaaacaaaatttatttattccaaatgcctgtgcttttgtcatattaaccaatatattaatgttagatgtgttctcaaatttaggatcttagatgttctaagcttttcctctttcatttcagttattgctgtcgacagtggaaagaaagcaatggattttcttggcttgaatgaagggaaggctgaatctcccaaaagtgatgtaagtcaactttcatggtaatcttttatcctacatttcataatttacttattgttctacatacttacccaatttccatacaatgatctctatcaaaatattggattgctcaacatctttggatgattacacatagtagtctgcctaaaagtatcatgggctttgccagtataatgggcaacaaaatgtttttagggaaaagctaaaaactttagcagcagaataattaagaaaaaaatgaaatgacagttgtagtttgcaagtgttgtccactatcatgttgagacttaaaattttgggaactcttgcaacttctaattttaaaatggaaaggaagtacattctaaaaataaggaaaaagaaaaaactttgtaataaaagtctgctatcatagacttcataaaaagaaaaatgtatcaagtgggatcttcttgatgaatttctctaatgagattatgcaaatgctgaagctacatgtgctagtatattaatgaagagcagatggtctcatgcaggtggcgaaactaatgtttcaacagggcatgttttatatttcatgaaatttatgcaagaaaatgtgaatgttggaacaagcagccaagaggcaattcagtgtctcatatgagtatattttagttttaacataagttagattgcatgcaggtatattgttatgacctgattgaaaaatagagatagctgaaaaaaggaactactaacgttaccagaactacatggactcatcaagatgtgacaaaagatagcgaaagattgttatttattgtgcatacagttaattaaggtgggatattggaaaaaagtaggtcagagtttgattgtgtgtttgactgtacttttatagtttagagagttctgctgtaatttggcttgaggagcataatatggtattccagggtggaccaaaacttttgggccacctgtcttgacctgaaccgggcctccagtggcttggcaaaaggagataaacatttggctatgagtgtaatgcataggagtttgtggattgttattcaacaggagttaagatttgtggacgggaagtgttgatccacctggtgtaccatgtcatgtaccacacaggaaagatgttgagttccagatgtatcgcatatgaggtttatgaaatctaaaggttacttcttgtatatttgtggatttttttgggggtaggggaaatggagcctcttgctctcgtatatgcaagctcataacatcatctctcatgcaattttggagagctgagggggaagtttccccaacaaaaataaaaataaaaaaataaaataaaataagatccttgaattcagctgcatgttgaacaagtcaaactacaggctgatttccaccatgtaggatatgggatgcgttggatggctggagagaggttctaatttgccatatatcaagaagacatgaatggtatgatgctgtcagagtccattctactcaacaaggaaattacagtagatgaatctcctctccatattgcagatgcctttcaaacccgtgtgacaatcataatccctttccaagcaacatgcagctcaggtataggaaccaagaccttactaaaatgaaaaccggccaccactgtaacagctccacccatatttctaatcatataaattagatcaatacatccacatctaataatatgtctggagtaaccaacaagggtagtctaagagttaagtcatctataatgggggatttggtgtaattgaaggaggacataaaactcagcaagagtttgagctcataccgtgaggaatctaattactaagagtttagtcatctataatgggggattgttgtgtaattggaggacaaattcagcaagagtttgagttcataccatgaggaatcacagctctatttgaccacctagctttaaatctctttgtatcgcttcttgacaaagagcatcttgaattttcatgacttcttatccacttgcaaatgagagctatggcaggaagtcagctgtatggttagtataggtggtgataatagccaacggatagtctggccggttaggtgggtatgctgaagggtggaaaatgcaagagtgcataaaaacgtcataaagatgataattgaggtggaaatttttttgtagagaggttgatgctgttggcaggtttagcaaggtaaatggagaatgtgagagcaaaacaggtaagaacatgatagaagagtgagatatagggtttgaaagatgtcaagaaaacagatatgaagacctaaaattgacttgatcttacttccttattcaccaaggttgtgttccaatgctggttatgcagtggatggcataaaattatccagctaaccagccaaacaccactcgaaaatggtgaataaattatttggccaacgagtgaaaaaggtagctaactaggttaaagttatttcaggaaggaaagtgaaataactttaaccaccaaaatatctctccccctctctatttttttgcttttccacaactttatccactaatcattggagcaccaaccaaacagcagataagtttatttgctggttagctgcttaggaggtgaataccaatggctaaagttattctaggggtggttatcttttcggcatccaaatgcagccttactctttggttacgtggccttctaaaaggctatcgaaagatgtgtctcgagcgaatatttcattttctggtcaggctgaaatgtcaatgccctcagttgtttcttctttactgcagtaacagtttgtacccaaaacttgtataaattatggtgattccagtaaaatcagctggtgctttggtgacatcttcagtttatcagcacattgcattgttcctcaagttgtattcagctaatttccattgcccataaccccactgaccaatcttcccttttacaaaatactcatcaatttggttgggaggaaaatcattcatcggtttgtctggccactcattaggaagaattcacaacctaatcaattatgtcatgtgatgcaggaccagaagattgatgttatccttagtgactattgtatgccagaaattaccggctatgaccttcttaaggctgtaaaggtatgttgttgtggtcccaattatcttttatcacctccagactgttccattctactattacgaataccatatgagcaatattaacaaatctaattaactggattgaccttgctcgcctacttcatgtcatttaataacttactttttcccttgtgtatcaggataacatttgctcaagatccatgccagtagtcatgatgtcatctgaaaatgattcccagagaattagcaggtcttgtagctacttccatcataatctgcatatccttctgattattcattttttccttctcaaaaaaaagggggaaaaaaactaaagaaaagaacttgtgcaagccaacattcactttaccttgcactatcatacatagtatttccagtgattagtgaaactacaatagaatagaattgattaagtacagtgggttgtgctttggaaaaccattagatcttcagaatcaaagtcagtcttaacccacatcagaaacattgtcctcaactgaagcctctgacttgtcataacctttttgcgaacaatgatcataagtccttaaaatgttcttacaccgaaaaaacaaaaacaaaaaaacttatgatttgcttcccagtacatcaacctttgctgaaccacaggtgtttccttttgcaggtgtctagctattggagctgaagatttcctcttaaagcctctacaagtgaaagacatacaaaggttgagaaactctgctaggccaacagcgccagcacccagccaagaccccaagagaaagctgcctgttgatctgatagcacagagcaatggttctgagcggcgcccacaccttgctggagttgcggtagcgtaatcgttcacttaattccaccttgtttttatcattaagtctacgtagtgagattccatggaggtctgtgttatcaggatctactggtgataagcaatatcttatttttattttcttattctttcccgcatgcttacaggcatttttgctggaattatgagaatgggagccatggatttatgttctttgcatgattgagacctcttcggcaggttttatgcatctattttgggatatatgagggaacaggataactagctgcagataacaagctatgatatcttttcacttgataagattattgcagcaggtgagaggggctaggtggagtgaagatgaggctttgctaaccactagggtctgatttggagggctctgagattggaaattgaaaggaactacaagtagaccggcaagcttgcatgaagggtgatactgtgatggaagcctttgtgtttgttggttgggttgagcaaggtattggttagataatttgcttttaaaattaccaccgccatcatcattttcagcaccgccatcaccatcattgacattactgtctctaccaccgccgctgctctttttttaaggctcttaagcttttctaacacttgaagtaagcatttgataaaactgattataggggtaaaagatggcatggcctaggttaaaatgtgtctgaataagacaacatagagcaatggtgtccagcttcatagaatagttttgggaggacacgtgcaattacaatcatgtagcaaatttgcctaatcaagttgaagctattcaacctaacaagctaagcgccatatgtttccttcctggatgaacaaaagtactggaaaatggcaacttcaaacaaatttgtctgaatttaactttaaccatgactctgctaatgacatcaacatgtttaacttgcagtcactgataaaattttttgaagaaataattatcagaaaatctccagcattagagaggcggctgcaacatcatattctgcctgtcatgaataatttaagaaatgctctttttaggtaagaaatttcataaaatgttttcaatttcaagagattatcattttagtacttggcatgatccaccatcatccaggcaaacaagagcttcctcacaagagcagaaatgacaacaatgtcacatgccttatagaacaaatcgctggatgaatcaagtttttcaatcagctcaacttatcacagctaactgatcaatttttaccaagctatttaaattcacagattaaaccaaaatgctaccatccattattccgcatcttaattaacagaaagctcaaaattactttcggcgagtgtttttatcatataaaaataagaaattatgcacaagaaactacacaattgcagggaagaatataattaatattataagttaagtttataagcaccttctgtacaaatgattccagtatttgccctgaaggataccacatgcaaccttcttcaagagccatcttgcttcggcttccggctcatttctgaatactgcccccccatcagctgcaaaatctcctgccacagattagttgaagaatctgctagggcactactaatcaactgtaagctgcatgcagcaacgacccaataatccgattcaatctcctcttgcagttgatcaaactgccacccagcatatccaacaaagaatctgaaatcctggggcctaagcacccctttcttgacaagtcccgcagcttcatctaagctgttccgggcgccaaaataaatgcctggaaccacctgttcgaagcctggaactgatgaattaccactggccttcagtacaaacatgctagcatcaagggggcccccaaagtgaagtgagcaatctgcaaaggtggttgcgaggtcaggattggatggcttcatatgcttgatcttcttgttgagagggcggttgagaatgactccaaatgggccctctcttgggtctctggttcctaatctgaggaggagaacaacagttctatcaaaactgcttaccccatcaagcttctcagttgcaactaacaagcaccctgtttctggcacggagagcgggtgggcccatgttagaccaagccgctgggatggcacatctgaggctgtgtcctctataggagcatcaggatctaccaactgcaccagagtaagcaaattaaagggttggcctttttattggacactgtcactatgtgtaaatacattttgtacagggaaaaatacattttgaaccctcaaggtattttgaagcttcaagattattcaaggccatgacttccccatggacttcaagatacaaggatggacaagattattctgaagctaactaaatgatcaaataaacacacttgctgcaatgtgtatgtattcaagtcccctcagtggacttcaagctattcaagtcaatactactgaccaccaatgttgccagagtggacttcaagatataatggtggagaagattattttgaagctaattacataatcaaataaatatactcattgattctgattctagtgtagactacaacattaaaagtttaaatgagttaaatttgaccatgacaaaatcaccatagcaataattaataactaagcaagaaatgaacaagaagcatcatgaaatttgacaagcagcatgagtggcatcgaatatccagaagcaaaaaatggcttcttatcattatatgaaatgccaaacttagcctcttatcattatatgaaatgccaaacttagcctcgccgttatatataaaagattctctaatggaatgatatgcttctctatttcgactagtcaactcacctgctcatcatgcacaagtttggctctgaaatctcgccaatcagacaatgtatgatgggacttgcgggaggactcactggattttgatttgtcgtgtaatggacgagttccttcagagccatctccctcaggaattgatggatcattatttcctgctaaccaaaaacaagtacaattaccagtacttaatcaattcaagagtacatagcattgaacatagagcatattcaggtgcaagaattcactagaagattcaattccattaaactaaacagtagttagaaattaaaaaagtgcaattctggatgctaggtcatttctgatgtttgatgatttataaaagaaatgagatttgaaatgttggtgaactaacaagtaaatggctaaccgttggaaatgtgaacagctagatgaccgcatctcacagtgtttcctgaaatactcatgatctagaggaaatagaggcggtcatcttcttaccttggagtctcaccataagtagatagaaatctcaagttccatcttgttctggctcagatttgtccctctgttatatgtgcatatataaatttttaaacaaaacttagcgaaaatgaaattaagaagttaaaattccaaagatttcatttcagcataaaacataagaccttatcaaccttaactacctacatttaaaatccttataagagcaggatatgtctccggcaaaaccagttccaactggttcatctttaagccccatactaatttctctgtgtcgtttataaacccataacctgataaccatccagcaaactccaaacctccagttttcatgatctaaatcctattagctctcattcaaaaaatgaaattagttttttcatcccttgttaatcatcgccattacataagatgccccttgatatggattccacatcagcaagaaattatagtttaacagatgattgctgttgcatgtgctgactgtgcttgaaggcactttcattgcatccctaggaatccttgaaagattgatcagcaacactaattaactttcttagttcaagatttgcactatttatttggagctcaatccatagttttaataggttagcttgctagattcaaattctgagtatttgttgcagatgggttaggtggtcattttccttgtatgaggctcaggaaactttgatgtttatattttcctgcatcttacctatttatcgcattgtccttgaaatgcattgcagtgcatcactaacgagtgcatttaggtcattctttgaggtttatcctgtgtcacttcgtataggagattatgttatgcacaaagtaaccaagcaatgagaataataacaacataattgactgttggtttgcaatcaagttgatgcaactctgggtgagcttaatcactatacctcaaggcagatttataacaaatggattatcagaattacaaccatggagatttgtatgtacatggtacataaagcactacgcaccaacaccaaaaataaaccatgggaagaaggcagcagcatctacagcctcaaacacactctgagtcataactgaacaaagagagcatttagtacccaattgaaacacaaggggtgcctctagatattcaaacaaaatcattattcctatggcgttgcatgcttttttttcaaactacaggtccttatgcatatctaggtctttgattatacaataacctataaagtatcatagaagtcccaacatcatgaattgaattgtctacgagtaaaagttttctgaatttaaatttttctgtgtcatctcacacctctcccatttctggaccttccctttttaacaacaaggcactttctagtatagccttatatttcaatttcaagaaagggacaaaatcatgattttgaaatttgaaacacccaaacgtaacttagatttgaccgaagaggcgaaggaggccccacagaaattcgcctatgaacaggatcctgtagagtataaatatcatgaaaaatcagataattgagaaagaatcttcatgagctcgtgaagtcagcatgacacaactgcccaacatctgcaattcacttccaggagaggtccaggagttctcgttgttcaaagacaaaaggcatgttcccagtttaaacttgcaactattttgccgagttttccagcagacagtatggaagataccaatcaaaaagaaaatggagaaacttttgacagagggtacatgcaagagagccttggacccagtttttgtgctaactgcaaaaaaaggaaatgctccctgatcctccaataaacacagacacatacatacctacatacatatatatacatattaaaaaggtctttctcctcattacatgtgaaggttggaggaggacttgaagcatgtaaagggagttctatatccattgttccgctcatgagagatcgggataaattaatgtagcaacagttctgcgacgattaacagaagaagaaaaaggcaaaaagaggatggaataagaagaaacaaacaacatgaagggccacgtttcctaatttgcatagctagacatttggcgatctatggtcggacttgaaatcttattttgacaaggtagttttggtcaaagatggtgaagagaagtgtgatgctgtattggcattaaaaaaaggtcattaaaaaaaaaaaagataatgttgatggttccaaatagtaaaaaaaaaaaaatctagttgacgttttccttgcgaatttaagaacccaacatgctaaaagagtcttgaagaggagacagacatattttcaaataaaagagccttgctgctccttttcttctgtttattctcattttcttgaacagtcttccttttaggcttcctttgggttaacagatgattgttagccacctttgtcccttctttagttttattgtaacaagttctaacaaaaaaaggccttcaaagggatttagcagtcatccactattagattatcaataggaggatttgaccacctgaagaacgtaaatctaattcctccttattcagttgtttatatagctattcaggaatcatatactagcaataatttgtatatatgagactccttagttcctacaagagagttgccaaacatttctataaatggggatgttgtttaaagattttaataactgctgaagcttatcccctactaaggcatggacttaaagtgagactaagccctaagagaaattcacagatccagagtgaatcttggtactttcttttttatcctcttacactcttttctttatttaatgctgtctgctttcatatctttattcttttggcaatcttgaacctaccagctaagctccagaatcccaccaaccactctttcagatcttgtaagcagccatctttacaaccatttaaacccagtcaacaactaaaaccgagcttggaaccacaaagactgaatgccattgagaacagatcaaatctgaacagtcttatcggctgttaaagtggcatgatgctgtgctcctaacaatcccaatgaatgctaaaacagccttgatgtgccttcttcaggccttacaccatcaattatgaaatattctcatgaatgcctgtagtctctctcttttcaaaccaaactagtcctctcttgctgcttaatcattccctctttgaatgcaaacctgaaaacctgctttctttcctttataaacagaaaaaaaaggatgaaaagaagtcatcttttatgatgcaaaaggcagaaagaaataaaatgcaaaattaattggtcaacaaaactcaactttgatcactatctacataagggatgagaaaggttcatagctatgagcgaattaggcccaaaagtgtctagcatcggacaacttagagcatggcctgcaatagcgcagtagggcctaaaaggtgggagaaattggagagcaagtaatttgattccttgctgatctatagcagaaaggcagaagttgaatagtttagtgggttgaaggaaacaacgaagatttctaggtcctttctaggatttagagatagtatttggtgctaggaaaagctttattagggttctaaaactaaagaagttctaatgttgacttaaaatttaatttaggcaatagtacatgtactcacacatttaaagagaagataagatggggaaatatgagaggaagtaaaagagttgagagataagagagatagggtggacaagagtagagatacaaagccacttgagaaaaaaagaagaataaaagggagacgagagagggataggaggtgagagagagagagagagagaggaagagagagagaggcacacaagaggaaagaaatcatttgccgacttcaaccgaaatttttcaaaaaaaaaaggtgaattgggcaacacagttgccgacttcgctcgttaaaaaccaaaaaaaattgaaacagagacgacccctatttcgaattggagttcaaaggtcctcctccggcctcagccgccctccgctcccttgacgctggctcgccggttgtcggagagctcgcgatagcggcgccatccatctgaaggcctccgatgatccaatgaggtctcccccgcttttcttccctccctccacccttagcaagctcagaaagagctccgacagccacctaaggccccctctccctctccttctctcccccctctctcttcctctctttcttctccctcccttcgagatggctgctgtgccgtttttcatgccaaaactagatccatatccccatcgatatggttcgacatggcctgcgtcgtccgatttgggatagttcagcggacggtgtttggaacattaaacaaaaaatgggcaaattcatttatttagaaacatcaagcatggatagtttaacatggactaacctagattataggttaatcacggcattttagtcaatcctgcttagtctttgatgctcaagataccaatcctatatttgttaaaattaatatgaaagagaacggaaagagaacagaaataaataacttattccatttcatgttaatcaatgcttttacgtggagctggtttcaaatctagttctcaattttcgcattctaacttacatcacatgatgtgttattgaccatttcagcaaataaaagaaaaacaaatatcaaagtgtatccaaaaatatacaatttgtaggtttacatccacaacttgtgaaagccatattgatagatatggaatacactttcaaaaattttcactagattttacacataattaggatatttaacaataagggcatgcaagaaacctttgataagtgaatagacaaaataaaatgatatcaaacatggtggactctgaagtatttcaaggaaaagaaaaatatagagaaattcaccaaatcttgaatgtagctgagataagtaataacaaactacaagtcaaaatggttttagattgatattaatcagagcacttgtttaacatggcacaccaattccaatgaaaaaaatgaacaaaacaagttattataaaatcctgaaaacctataattcaaatccaaaagaagtcaatctcttaaaaaattgtaagaaattcataaggcaaaactacctgacagacacaaaggatcgagatgttattttcttttaaacacaataagaataatcacgatcctaattttatgagaaccccaacaagaaacataagtcaaaatatctttgagactgcaacataacattctacttaagagaaaaaatgatcagtattcatctgtatgactagtcccatcatagaatttttgacctgacttaccaaaatcaagagcatgtgcaaggtctggcaggtgcaagagctaggaagcagagacttcccatgattttgagtaaggaagaacctaggaagttgatgcaggcatgagatttcaaatagttttcaagcaaggtatgacactagcaagaagaatctcgcaaaaaagaattcaattaaccatagttagcctcatgacaaatttaactaaacttatgaaagaaatacgggtcttgaattaagcttttaatcaactgcttaaatgcccaaaatggatgtgtgcccacaagttgtgcctctccatagatgttgactcaatcaccctcaataacatatctagcacctccaaaaggccttaaaccaaaaagaagttatagtcacaagcttttatgagcaactgtaactaacaatgattaaggtatctaattttttgccctggccttcatactggggggaatattatcatcttgggttgctcgctctccaaaacttgcaagcttgtctctcagaataaaatcactaaattactgtcttcagttttcaccacaatcattttgcagctaagggttcaaaaaatcaatataagtcgcttggtaattgagccttattgagctagacagctcaacgccaaaccactgcagcaccgtgccgaagtagtttgtccaggttggccccaagccacatattgcatccaacttcactgcctgaagatcaatttggcataacgtgtctctttttctgcaaaccatcactttgtttccgagcaatatctaaatcaacaagctgtctattgcatgttactgaaatcaacagagagacctcctccagtaccttttggagtcaatccagttttcaatcaaatcttcacttatttattcaaacctgacatctaatttcatattcagagggaatatatatatatatatatataataggttgaaccaggcaaatgcatgcttggatctagtctaacaaggatgctcaaggtaatgtagcgaggaccattgaggagaatattcacaatcttgtaggcgtcattagtaaagatataactgttaaaagaccagacaagtttcacggtaattctattatcaaccattgctgcagtgaatagaagtgctttcacatgattagaaacgggcaagatctgaccatattattaaactaggagaaactatgctactctgatcccttggaaaagccgaaccatttgtctaacaatgttagcagaaagcaacacaagttgtgaattcatctctataatggcaaaagaaaagaaacctatattcccaatattcagtttttccttttttttttaaaaaaaaaaacttttgttttccgtttggacttccaagaaaccgatgaacctaatctaaacaccgaaacacgaaaaagaaatttaaaagcatgcttttttttctacatgcatcctgatcaaacacatccatcacctttcccatcagatcgcacccaaacagcaccacccatctcaaaaaatcctataaaaaccagcacgaaattcgaggagcagatcaccaaagaaaacaaaagagaagacctttaccagaagaaggggagttatcatggctcttcttcttgcccgtagccctaaccacaagagatcggtacctaaaggaagaagtcctccccgccctcctcgacgaaaccctaatcccgagacctccaccgaagccgaggacctcctcctcgccgccaaggaccccccatccggcgctccgcctcacggtcagcagccccttgtccagcctcttcgtcgccgccccccagaccggacctccactcttgggattgagagccaagacgtccatggccgagctattgatctcggaattctcctcttttctagggttttattctcgaattttgggttggagtagggaaatttgggagaaagaatcgtttccgatggggagcgagaaagaggccagggattgggaagctacaagagcgagttaccggagtggggaggaaaccttggggtgttactcaccatccggtgagggtaagcgaccttttaactttttttaattaagcggggctcggctggatgaccggacctccactcttgggattgagagccaagacgtccatggccgagctattgatctcggaattctcctcttttctagggttttattctcgaattttgggttggagtagggaaatttgggagaaagaatcgtttccgatggggagcgagaaagaagccagggattgggaagctacaaaagcgagtgaccggagtggggaggaaaccttagggtgttactcactatccggtgagggtaaacgaccttttaactttttttttttaattaagcggggctcggctgggtgtgtcatccagctaggagtccagcaggaggacggccgttgtaacggtttctaaagtccatctaataagttttctccaataactggtgcgaatcaaaccaattctcaaaaattgaatagattttctcgtgcgttgtatgctattaaaaaaattgtgtgattaaacgaatggagggtgttcggatccaattgagtttgtggtgtagagtattaatccttgtataatgccttgccttggagtttatcattttttatgcaaggattagtttgtctcctttaattgggatgcatggaattatgggataatttaatagttcataaaaattatttatctaaaatataattataaaaaaaataatttttattatatttaactaataaaaatattattttaaaaaataatattaaaaaaattactatatttagttggaggtgatcgtatatagaaatatgataaaatttataaatatatttttcaatataaaataattttaaaaaaattatacagatatctccttaagtttatttcaatttcatttatatctctttaaatttaaatcgtctcaattagaccttccaaattatcgaagtgtatcgatgtgctccttccgttcatcttcgttaaccaaatgctatcacatgaccgtcacatgatattctatttttttaaaataataaaaatattcttgatttcaattctcagtcgagcattagccaaagcgtcaaaaggtaaaatcacatgcctcacgtgagccattattttggatgccctaaatatagagaggaggaaaacaagcgagtctatggtccttgctgagagagatcttcgatcaagctagccgtggtagagaaggagtcgccatgtacgccgcaggtggagaagaaaaaattcatgaaagaaaaagaaggttaccgatagagaaaaaagcaatgaagggtttccaatcgagctcttccagttacacctcctctcaaagtattgatttttgtcattgtggaaccagattgctactgagaacctttgggaccaccgcaaatcctggtcggcatttctttagatgcagaatgtatgaggtacagcaatcatttttgtcattttctatcacaatgtccaatctttatgtttaacttcgaattgtttgtcaagtaaatgggggctctgggttcttccattagcataatctcccttcaaatgctcgggacaatggatattattaacaagcttttgcaacgaaacaaaaagcttgatgaccaaatactaagctacaaaagaaggaccacctacgctgtttggtgtatgctagcatgctggattgttatgcttttttatataatcgattttctattttaaatatactgattgttctcgattgaatgtctcaattttgttttaaaagtcttgtactttgtttttgggacattttgagtaggttgttgtattttgtaattctttatgaaatgaaaaaaaatttctctagttgttagcaatgatggttgttataagtgctacattgttaatggtacagtatacttataagtttcgatgaacacccctgatattttattgctattacgcttacaccccctatactatcaaagcgttgaatatacatcccttgctttcaaaaaaaaatgaacaaagatatattatcttatacagtttcagaatacctataagaattttttttgtcacacgcatcaaaatatcacaacttttaataaaattttacaaaaaatataaaaaatttgactgacaaatcacaatgtatcagtgcatagacagaacaatccaaatacacccaagtggattcaaaaatacatacaaaatacaatgaagtcccaaatatatctaaaatggccttgatacaaccaaaatgtccttgatacatctaaaatggccatgatacatatcatggttgagatgaatggggtgctactgtctgagacaaataacctactgctgactggaagggagctggttgggagaaagaatgagaaggttgacatgtagtagcttctggctgggaggacagatgctgggagggagctggctaggaggaagtcgctcctagctgtaaggacagaggttgggaggaaactggttgggagaatgtacccactgaagttgctgtcttctttcttctcccactatctttggtctataaaaaaatacaaaatgataagtaaatatttattaattttaatattaaatataaatgtaccagtgatctctctcttttcctactaatttgactctcagtttgactaaatgcagtggtatcttggtttttctttgccttgtccttcctagaacctttgcaagccctggagttatggacccattgttgacaattcttgcaccttaaggatgtacccttcctatatctattagaaatttagaatctttgggcttatcattttcttttcttcatgccttcttgggtctacctggaggagcccttagggaaggggggatataatgaaatattctgtccttggccaagattttatgcttggtaccggctcaataatatgttcataggccaatgcctatgttgctttagtgtaccatgtactaacaaaatattctgcttccttcctaatatacataatagctattacagcatggcagcatgggatgccagttaaatcttataccctacatccacatatactctcctctaaatcaacaacaaatctatcattgtgatgcttaatttcaattttgtagcctcctccccatatgcagtggcagtccatggcctctaactttgctttttccaatttcttttgaatcttaggacatagggatcttataattttctgcaagcattctcttttggattgaaatcattgtatcaatagcctccaaatagtctccaacaagatgatgataggtttgtctcgagcatcaataatatacttgttgaatgactcgcatatgttgttcaaaagcatgctagacttccttctatcgctgaaagcatgcctcgcccatagctctggtggatgttgtcgaagccactgccatgttgtctcatcgaactatcgtagctcctccatggcagcctcaaagtctgaaagtgtgtttgctctagtacactttcaaaggacatctctatagttcttactcttaaatccagcagttttaaaattgacgtgcaagtgtcacacgcaaaatctatgatcagcagtaggaataacactcttgaaggtctccacaggacccaataaaagaattgaaaaaaataaattacgtataaaatcaagtgtattaagagaattgaacaagttttttaataagataaataaaccttctgtctgtcagacataaagatccatccatgctcttctaatggactaatatcctatagtaagttaaaaaccaactccattctttcatctcggtctctacaacagcccatgcaacagaaaaaatattttcatttctatccttccccactgcagctaggagctgtcctccaaaagagcccttcaagtggcaactgtccaaaccaatgatagatctgcaacctttgataaagccctgcttgtatgctgcaagacaacagtataaccttctaaaaatgggctggctactctcatcgacctactaacatccaacaacatcatgctctcaggattagtttgtcggattatctgacagtatttccacaaatgggcatactgctccctgtggctgtcctaaataatctccaatgctctacttttggccctataacactgtgctatgaaaatagaaatctttatatctctcctaacttgctctcgagagcccttgacactccattttgtgtcacttctaatctcatcaaaatacttctctgttagaaaggtggatgtgacattgtgattttcaaattgccatctacagttatatacaggttggaatatctttatttgataggtaagctcgctctgtacagaaaaagtatgaatcttccacctacatacgagcttgcatacagcagttatccgataggcctcattcttcttgaacacatgatcaaaatcctcctatatgctataaagccacagcactttcttaaactgtgtgacattcttaaaagtcattctaactgaaagttttatatttctcttaacatttgtgggttcattgaattcaggatattcagaacctcgaataccagcatctgaatcactatcattgctcaagctacagagatgggagctgctactactatttgatttcctaccagtaggctgctcctctccaaaaaaatcaactccctcatgaggtagagaatgatgtgcccaagatctcaactcctcctcaagtacatctctatttacataatcatcgaaaagatcatcgtcatccgaatcacttagctgactaagtgattcatcactgctgcttttacaggcaaccgtaggatttgaagtgacagcttcaatccctttcaatttcttatcaagtttaaacctaaagccacttacctttttcattaccaatctctttacccaagttcttggtgttgatgcattgtatctttttagtgggcatctgctctcctatgactgccatacacaccaacaagctttgtttgtctgtttcagataaaggaacatcaccagcatttgcttggtgctcaacatatacctcaaccatatcagcacctcgcattgaacctaacatctccaatatgtcggcatgacatcttaatttcctcaagccattttgtaatgtctgtcatggcattaggtaataaaaatggttacaatttgtgtatcctaactagctcatcatgttctctatctctgtgatactaaatctgtctttatcacaattatcaaagtatcgactactatcctgactgtaatggtaggttagatggtatttaaaagatctactataatgaatttgtacagtaaataagttagagtctatctctgcacaatgaataagagacatagaatactaaaaatatgttatgagggtcataattagtttcattggctgattacatttgtcaattaaataagtcaaagtccatgagaggtatgccagaagagaatctgatctttttcttaataattgggttaatctgatataacaattatatggacatgtacaaaagataaaggacactaaaaaatactaagttaatcagagtctatccctacacaatgaacaagagatataggacactaaaaattactgcttggctaaactgaaacatttctaaaaagagaatgatatttgactgtagaaggcttcctgtggatcctatctgtcatgctcacgtatatcaaaaataggaccacaaaatatatgaggacaaagggaccacaaaaatcaaagaaaaaaatcctaaaagtatcggtttacaaccataaaatcctaaaactatcggttggccactaaagagacatacatcaatagaataatcaccataatcaaaattttatatgaaaaatatattgttaaaagatgtattatcggcaaaagaagatataaggctcatccacagataaaaataaggtattcaagaggctatcacgctcgtgcacaagggaggagacactgctcagccaaaatggagagtgggatggaggtcatcatcgaaatcttgtcgaagaacaatcgtcgaaagcaacggatgcaaaatgacggatgttgaaaaagggagggtcagcattgtaatagattttgaaaggagggatgggcattttcatcttttcgaaggataatataatgatgttatcacttaaatggacggaaggggcacattaatacacttcgataatttgaaaggtttaattgagatattttaaatttgaaggggtgtaagtaaaattgagataaacttaaagaggtgtctgtataattttttaatactaggatagcattatcattttcaattaatttttatataatgaatataatcacataactctttgcataatgctatcttcatcttaatttttttacaaaagctctttattgaataaatttggatagacattaaaacaaatttaataattacatatgtagctttattgaagatatttctgtcaggtatagattatcatcatttagaaattttctaaataccaacctctcatagtatttgttttacattctctcttaaacatagggcccatcaatttttttatcatttttttatttcattttttatactaaatattataatttgatatgggattcattttttcataccaaattatccccaaccaaaacaaactttcagagcatcttctttttttccaatgatagaaagcattttcatttacagtgtaaaatgcttgttcttaatagttatattatattatttgatcacatttatcaactttaaaaagtgattattttaggtatcaaaaatttttaaagtatattaaaatataatgttttgtcgtttttgaagaaggatgtggcaatagaattatagtcaatgccattataatgcattcaacaagactatactctattgcttgcaattgcatgtgtacaatgaacgataacatatatcatctcaagaatttaaggattgaaagacttcacctttattttgtttttgatcaaagcttgggagaagaagattcatattatgctctcaagttagtgaggtcatccttaacttcgggcaatgtttgtaaaattggactaaactgaccgatttgactgattgaattggaaaccggttatctatccaaaataatatgaaaatactttaaaaataatcaaaacttggtcaaataggatgaatcggatgaaccaatcagatcgactgaatttgatccgattctcatgggtttaattttttttttttgagctcatggcatgtgttcatcttggagggccttttcaagcattctaatttcacccatgagtcttgcatgcctcatctatctccttaaccctaatgctaatttcaccactcccatcctcgtcctaaatctctccctctctccttcatcactggaatctagtgcctcccaactttgccctcgagagtttctccaaaccttagcttctctcacacctagtctctagggttttgtggtgctcaaggcctttggtggtggggaagatggagctgtcatcatcatcgttatctatgtcattgctagagttgatgcaaaagaagctctttgatgagataggaggtgctcacaagttttacatcaacacctcccccctaacaatatccttcccttgctctatcatcctccaagttattctttaacccaacccctcccctctccctccttaccctgctctccctctaatcacttcctcatcgaagcctccctttctgccttctttagtgccaccaccaccactcatggtactcacctcaaggttatctatattgggtcctttctcatttgctgcactaccattctcgacaacaccactactatccaccacttcatcgctagccctccctccttcgtcccttccaccctacaaggactaaacaagcctgctctattgaccactcccttctctcctcttttctcgactctggccagctccctctcctctaaacttcttaaagagaacccaacagggagatggtgattgcagcaccaaaagagtggagacaatgcatgaggtggatagtgggggagcataagaagcacttgagagtaataaaggagtaaggagtggacatgaggggcagagaggggagaatagtactgcatgtgatagtggggagggacatgtgagatatacaacggcattggtggatcaatcaaactgacgtgcaccaaccatgcgtgaagagtgaggaaggatgcttttcgagcatgtgagatgagggcaattaaattggccaatcagatcgattagactggtcaacccaagaattggataacttgatggttcactatctaattcgattttaaaaatattacttttttattatcttttatcgcactaggcatttatactaattaatatttacttcaatggatagaaacaatataattaaaagattggatttgttctctaggaatttgctttatgagaaatagaggcatgaatgtatattaatgcttgacatgctattgaggagatgtgttgttaccaaaaaaaaaaagagacgagaagacatgtttaggaaagtggatttaaggctgagagtttgcttcattgatagtgcaaaaatatagatatggatcatggaagtgtcaataaatgcatcaacacttctcgtgagccacaccaatatataatctgtattcgtatgctcaaaaatataacaggtatcatattacaactccaatgaaaacaatgaaagaagcttcgggccattaatgcgcacatgagaagttcacgactcacaaatctcaggaatggtagcagatcctatgacctgcaccgacccaagtacattagcttgcaagaaaattatttaaatatgcacaaaataggagtcctataacattactttaaacgattgatattatatcaagaatggcagctgttgtcatatactttacaatatttacaaaataaaatattattttggtatcaatgcaataaatacaaatatacaatgaggagtcctaactgggttaaataatgtgtttttttggctattataatcaatctgttatgtctctttataacaagtcaataataacttttataataatatattgacagcaacaaaattaggatgatcttatcaattgaaccagttggcaacccctctctccgaactggtatttggccttctctgaatctttttgccccgtggggaacgtcgcaacacgccaaaagccgtggcgcaggttttgcaaccttgaatggtagatattaaatatggataggccaaacagtggggtccatgccatcctacccgaattaatccagagaagcggggctccagattggagaagcatgggtatgcggaggccgtgacccttttagaacctcgaatatgctcaaatatgtgagcgcggatcctctgcggtaccagtctacgaatattttgttggggatggtatggctacaggtaatggtatggctccaaacaatttaccaagaaaagctccatgctcgcatggcatgttgcggtgccaagcaccctcccaacatgagaaattatatcctgtaccgtatccaccacatgatgatcactggggccgttagttcattcgatcttgatagatccgatccgatctgaatcaattaaatttaaaaattaaaaattaaaaattaaaattaaaaatcgatctatataaaaaaaaattcaaatcgaaatcgaacaaaaaattttgatttaaatcgattcgattatttatttttttattttttaatttataattatttatttttgatacaacatattcaaacaattattgtgaattcattggtttgttacatggcatttaattaaattcagaatacattgaatttataatttttaaattaaaaattaataattgataaataatgatacattgataattaataaataataaatcgataataaataaaatataacatatcaaaaatcacattatctacaatacaaataagtaattaaatattacagtaaattttaataatagatcaaatctagatatccaatcatccatctatataaccaataaattctcaacatggtaaacaatataaatttaaattataatttcaatttttcgtttgatttttaaattttttgatttttaaccgaaccgaatcgaaaatcaaaattcttgaaaatgaaaataaaaaaccgaatcgaatataagaaaatcgaaaaccgaatcgaactatattcgattcaatttctgttcgattttttgattcgattcgaactgattttcgatgtgaaaccgaattatgaacagtcctaatggtcaccataccaaccatctcacttcattcctatgtactccatttatcatgtacttagtgattagcctacaaaaatgatataaagtgatagatgtggtgccctaccatctggtgtatgtgatgtaggatataatttttctaagattgggcctaaaaaacttttttcttcttcaatttagtgatggagataaaataagttcttgaaatctcttaatctggacaacacacaactctaaaatttatattgacatgctgactctcgaaaaatttaaaatatatttagttgaaaaaaattgggctctagaacataaaagaatgactctcattcttgccattagacagttagactaggaggagacatattgtcatttcgatttcaaaaaaaataaaaatacctcaatcccccaaagcccaatgcctactctcttttaatattcaaactctatcctgatttcaattctaaccacgaattaaatacatcaaaagatattgatattttgattttcattccaatccatttcgattctacttccgactgtgaatcaacacccacttaattgaaatttcaaaagaatccccatgctacaatggctcaaggatacaaaatcaccacccgttgagttccaacataaaacccatcaaacgacgctgagttaccctccaattgccgtcatgttctagacttaatgcacgtagatgcctaatactcatcacctgtaacaaccaaatttttgatgatatttgaactagctaataatatagaattatagaaagtatcagtttttctaagcaaatgatcatcatacctacatcccacatctctctcacgaaaaggaaaaataaaaatactggttgaaatgattccgaaaaggtaaccatatgagaagaatattatgagaataggtgcaaaaggcttttcacatggaatctggagaatacttctatcaggaagatgtgaaaatagacctagaagggatttggtaaaacaaaatgccacaattttggtatcatatactgagattatatgctttcatctaaatctttatacatcatccaaaagatgttagaagaaaaaagaaaatattgaaggctaaaaaaggacaatgaattagactgacgtagaaaacatagtataagtgggtgcaaaggtggctatcttggtgccttaggaagtcttttgctcaagatgaatatcccagcaatcaaaagcctaaatatcgctcagcagttgaaaagagaagggacctggcaccgtcctaccagcaacaagtaaatatactacagtgaccatcatgcaccaggtgagataaatttcttcttaactatcaaaaaaggcacaaaataggtgaacatcttcatatcccatgttccttcttcctgtgtgcacatcatacaatgcccaattcctatgaaaaaaattgcagcattgactccatgaaaaactccatgatacatgagcatatgctcaccaaaggccaaccctatttttgtgtggtttcatgtgcactccatgcaaaagtcttggactttacacagggataggcatgcttgaggcacttattctagcaggacactcaggcctcaaccataaaataagaactaaaacaaacagcctgattggtgccatctgcttttcccttcgtgttcttcattagcacaggcacccaaaaagggcaaaaagaaaaaaaaaagacttaaagctccaccctatcacaaatctccttagcttcaacattctttcttgttctagaccactcatcactctatttctttgttttcatcatccagatggaaaaattattgccccaaatcttcatatcaagcaagtaatactcaaattaaaaatataacttgttgaataacttgaaaaatcagcataatcgaacattaaaaaaaaaaaattaatgtacaaggttaactaaagtgcaaaagaataaaaggataccctgcagattgtatgtagaaaatatccagaacattaatcatggatagaaaagaaaataataaacaagaagttcatttatcaagaaagtcaaagcagttcacacattgagacatataaaaaattgttttttataacataggtagctagatccaagctacaaatcctctaaaaccaaaacagtaaatagataaaaatcaaacctccaacagtctccaagtaataagtttcttgcttcggttgatatttaagctccattctgagaaccaactgtagaaaattctgacttgcttaagaagacagcaacaggattaccaggtgaagggggattctgagttagcaatgagatatgtgggccagctttactacgagcagcatcatcagaagcagacaaaacttcaacatgctcaagacccagttgccgctttatcaaatcggagttctcctgaagaacctctatttcaccaaatggcagcttcaaatccagagcctgaagaccaaccaagcgtacctcatccttcttaaacttcaggaaaggcatgcagagtttcagtatgttcttaaagtttgcatcctgccccacagcgcttccttttaacgcttcaagtatttcctgatcaggtgcaaaggaacctttagcactgtcaaattttgtttgaagtatcctaaggcattcttctttccaaccatcatattgctcgctcacatatataagacctactgtgaacttgttttcctctgctggagtaacaggagcaccctttttagccttcttagggccagatacttgcttctgaagcaactttctcatcaacgctattgaatcctgcagatatttgttcgctcttctgagaagaagatcaggggcatctgccatgggccaaccagcattcactacaaagccatccttcttcaagatattcttccatacatgctcggcatagtgcgggcaaataggagttataagtcttgtctgaacatccataaacctccacaacaagtcacggttcattcctcctgccccacacgaaaacctatattcatctctggcagcctgaaggtcataaaatcctaccttgagagcatccctaaacatgaaatcattatagtgctgttcagctgttttaatggctatgtttatttcatttgcaaatacacggtcggcataagtagttggggggccagctcgcaaacatgactcagaaaccaaaacttcttccatccaagcaatttccttggtaagcctcaaaattgcagaatttgctgtttcaaagacaaaatttgcatcatccattccatccccagcatctgcaagagaaaatctggtggcatcagaggagaattcctctatggcctggcgaagggttctaaagttccctgtggatttggacatcttctctgaattcagcataagatgcccattgcatcggaaaccacggggccactgctcttttggcagaagagcagtgtggttatagatgcaaaatgtaaggtggttttgtatcagatccttgccagatacacggagatcgaatggataccaatattcaaactcatccttcattttcttaaggagagatgcagggatgtctgttttggggactggccctagaccaaagacatagtcccatacttcatctgtcatctgttctggctttactgaagaagtatctaatccatacatatcaccattttgcaaaaggtgagcaatggtgtagtatgccatgtatagggttgagtcagaaagtgattcaacaagaaactgctcatcccatggaatatgggtaccaagtccaaatgaccttgaacatgcccactggttcagccagctcaatgtgtgctcaaaaccgtgccgtgtctcttcactatagagcatcatgctggccaaacagtcctctgatttttccttccactctgtctcaccataagtaatataccactgatctgtaagtgccacgacacactcatcacctgatcttgacataactttcttctcaggctcactatacattaccgcttgtccggtccccagaaggtcattccttatcaaaggctttgcttcttgaactttcttccctttaaactcccccaccagcattgtaccatcagtaaagcctttcaaatatgtcaaccttttcgcctctgcaagcttatctttatcattctggctcttgatcttcagatcagtacagactttctctgcagatacatctccaaactctggaatattaatgatcggtatgacctgaaaaggcatgacccattcatccttaaccccaaattttgatctcaaagctggttttgatttcaaatcttgcaatgccatatagtcatcaggtgagtcactgggcacactggtcacaattcctgttcccttgtcggttaagatagtaagcatgggaagtgagtatatggtttcgttgaaagcgagaggagactttaaagacaaaccaatgagatcatgacctgtcagctcaagcaaacaagttggcttctctggaacccttgatagtttctgataagccaggttaagtgcagccctctgggtaataatgaaaacatcagtctcattaatctcatatgctccatacttcccatctggcagtacccaacagtttgtttgcccatacattgtctcaggtctcaaagtagcagctgccaagtaaacttttctaccttccaagaccttcaactgcggagggaaaggtggggttatctccattttgattaaaacatactcttgtggctgaacaccttcaccagaggctctatcatgatcagcacatggctggccatccaacggagagtaaattgtgtacctcatatccttcacaatcttccccatgcccttcaacttcctcatctgccatctaacaaaggaatcatagaaaggattcatgtctgtagttataaaagagcgtctccagtcacagcccaatccaaaagccttgagatcctcttttgccaaaggtggaaaataagtcaaccagtgatatgggtcttggaattttgcaatatcactgtccgatagaccaaagcttctcattatctcccattgtgacttatttccaccagatttggcaacagccttggaccttttgctcttaaatttattgggggcaaccacactactgtcttcaggttcgctctcttcaacagcttcagtagtagaatcctcctctgtggaagaaaacacaggtggatttccaaactgctgaacctctcgtgcaagcttatctgctgaggccttgataggcatcccggtgcaatggaatgcaaagggcaggagaacattacaaccacgcagacggtggtatgcagcagcaaactctagcttggacactgtgaaggcatggcccaaatgaagcaagccattcatgtatgggtacggaaagttgccaaagaacttctcgtcgggcccaggaggcttgcttccagggttggcctcgaagactttgtgttcttcccattgtttttggacttctgactgtatcctaagcagttggtctctcctagaaaagctcctacctccctcagtgtttgaggccatttctctgttatagtattgcaagaattcagatattttttgcgatcatattcgaataattcaatccaataattgatactgggtatcaaaatcaagagcttctttaaacagtaacggaaaaaaaaggatcagtcaagacacaaacaacaagaaactcaaaagaatatctcaaaatcgatttttttttcagattatccactctatgtctctattatttttcattacaactgtgacgaaaaagggagaaaacttatatcatcaaaaaaaaaaaaaaaaaagtaaagtaaagaaacttcaagcaacataatataaaatcatcagcaatagcacataaagtgatcactctagctttgcttacagccaccatattccagccaaccctaataatactaaaattcgagcaaaaatacaaccttttgtcccgagccttgaacagctaccgataatctacaagaaatttcaaccaaaggaaaacatcaagagaatctaaaacattacaatagcctgacaaatacaataagacccagccataataatgctttccctcaaaatcaaaagatcaggctcgcaaacaagcttcggattgagaaaaccaataaaaatcaaatattttcctacagaaaagcatggaaacaaataggagagcgtccaaacaaagagattggatggagattgggattcaatcctaacctggagagagtcgggagtggaaacctggatcggaaaagggcgggcctttgaaggagccgcttgaagagaagggatgaagccaggagagacccaaaagtgatctagggtttcgttgcgaaggactgcaaccggaaaaagactggtgcccacggtcctgcagcggtagaattagccgctctctcaagctaggagaagagggtttaaatagtgaacaatcttagccctccatccaccaaaacggaagacgtttagaggatgaatatcagctcgtttctattgaagattgtttaatgtcataataataataataataataataataataataataataataataataataataataataataataatatatatatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttgctttttcggagatggggaagcggaggcagatgacggcggaggccggtcggaggtggcggcgaggagagcaaacaggaggtcagcgttaaagaaatctgtgggaaagaacgcacctgagaaagattggagagaagaaggcgacgacagagaccagcggggggtgacggctaggagagtagggaagaggtgggcattcacgacggctctgccagacggtggcggcgaggaggtgggcgctcgcttagggctcgagaggagtttgaagaaaaacaaaaggctgccgctgaaaatacaccaaacccagctcgcaagtggcgtccgactctcgttcgttgtattgtatagatatttttaatttgggttggaattgggtcaagcagttcgacctatcacgggtcaagaaaatcccgattgggtcactttggtctactattgcaaaatatattgaagctttcgttactagctaaccccatctttagctgacttgaccacttgtcattcaagtatttcaagggtagcacactgatatagaatctacaacaagtcaagtcatgatggtttgagctgcagtgaattgggtttggtttggttgcgttgggttggatcacgtaaaacgtatgacatgagtttattgggtgggattaagcctacaaactctgtccatggaccggtttttcaggttttcagttaggatacataaaatttatgcattacaagtcaaatttagcaacgtttatgttttgactcaatccggctcatcttgaccatgccaccatgattgtagtacattgccccatttaagaaattagattttcttggaggtttttttttttgcccccttatatgaatcagatcaggcatccgagaatgtaatcaagttcgtaatggacttctttaaaaaagaaagaatagttcggaatgagaatttgttccaaagttatgttggtcccaagcaaaatttttagcccacttgtggtgtggacgaatgtttcttttagtagttgcattgctaggattgtatgttggaatttaatctgattaaatttatccagatatgatccatactagcatgcattaggatttgtttacgtattttaatttaatctagactctaattaaagataaactttcaataaaataatatagatatatttgattgttattgtgttaaagtcaaactctacgtaatcattatggataatgtctatctcaatatttagatattaggagtagcaaaaatcgatacgacctgccaaatgagtacagatcgtaaaaagttaacctatttaatatgtttaataatcgaatcgaattcaaattttaaacagttgatccatttaacccatttaataaatggattatgataggtcagtttggatcgagttgtaacccataaactcgcaatactatggcttaaagtattaaacaatttaaactgaccgttgccgttgatccttcgcccttcggtcccatcttgagtataaaaggctcttactctctttccaccttcgatccgacttctagatctagggtttttgggtttccttcttcagtcctctactcctccttcgatgaccagtgcttctagctttctttccattttccaatggcggctggaggtccttcactcttttggtggccagtgcttccagctttcttcctaatagcagctgggcgaactgtgaagccaaacctccttcggtttcctcctttgatttccttcttcgatcctccttcatcattggtccttgagaggaagaagctgtactcatcagcactcgactatcactaagggagcccaaatctatgccattttatttcttcttttcctctccaacagccattgctaaggaaatttgtattgcttggcacctcggtcactcgagatctaggattttttttttcttattttaatggctcatgctttttttttccctaacgatcgtcactgatatcttgttatattatattttatttggaacttctttttaatttttgtttgactaagaataatggatgttgttatgttgtctttgtttgaatttttaggtacttgtttagattttaagcaattttgagattgctttaagatttatatatggagactataatgatttttcgatatatgtttgatgattcagctatttctagcagtaacaatcttggacagccttcttgtataggtaatcgattatcgtcattttaatttagttgtagattaattatcggatctaagcctcatcttcctcttctagatatacatgggtctttcttttccgttctttgttattctaatgattttcatatgtagcaatattattgtcattcttgagatggataagaatttggataagtatttccatatatttgaagttgtaggatatatttgaattcttcactctttctctatcaatattttgtactcaattgaatattactaaaatataaaattttcatatagaaaccaagatgagttctttctaaaaaatcaatcaaaaattatttctagctagttatttttgttcaatttaggatggtttagattttttctatatttaattttctatttaaattttatgtaatattgtacgatggatatctagttcttagtaccagatcttttcaggctattgtatttattaatcttggcagctttctataaaaaaataattattattttttatattatattgatcatttgattactgttattatttaactctattaatttaagtttacttattttttatatctatttttgatgtttatatttaagtttgttattaaaattaaactaaacaaatcaaaatttaaatagtattggcccaagaacaatcaattttcttaaacaaacaagctaaacaaatcagactagattagttttgttaaatagattatttatttagtaaatagattaaacagattgagtcagatcagttaaacatgttactcgtttaataaacaagttaaacggggagaatcggatgacttatatattaaacagatcggattcagatttcgaaacctgatctgtttaataaacatgttagatatagatttgatattttctgattcgacccgcatctggcccgaccctttacgatctgattcaattgccatccctattaggtattgtttctgatgaatgaggcatgttataaacaaacaccccttatagacttgattcccaacttatccgaaagagcttgtgaggtcattctgattaggaatactcagtctgattaggaatactcagagttgagattggcaaatcaaaatgctacttagagataatgaagagcacattgagttcaatttttttttgtgattgtaggtagactgattccaaagatcacaaatgatattggtaacttcttcatgtaagttttattatcgtataaaatttattatcataatatcagagctatatagattatttggtttgaatattgaaatcctttttatatctatataaaaattttatgaatataaatctttgaccagccatcttggttggttgtatgtaattgaagttgtcatcattagtctaacgatgcattcatagattttatgattgtagaagtccgtattgttttattgttttatttatttatttatttatttatttaataagcttatgatttatttttttaaaaatttaaattatttttaaaataaataaataaataaataaataaataaataaaaaaggatgacgacactcatgatttctcaccgccacgccctccctctttcattcaaattggtcggactctggtctaccccgacaatcaccgcaacaatttccgctctccagcagccaccgaactttcaaataaaaaaaaggagggtgaagatgaaaccgtcggatcttgatgaattgacggtttcctctcttggtaaactttgttacttagtgtaataaagttgcctccttacgaagaaaaaaaaaaaaaattagccgacggagtctgtaaaaagtgcttattgtgtaataaagttgcctgcttgccaccaaaaaaaaacacaaaaagaggggcacacttgagactaaggtacgcttcaatctctgttcatgcctatcacagtatttatcctcacccacagatttagtgccgtcgaactttggtagctggctacttaatttgatatcttcagtcgaccatttgggcattgccaatttctggacaaagtgaaagtttccagatgactttgtgttctgcaatcaaatttattctcaaaacttgtctctgtttagaaagccccttgcccattaggctgattcgttgctgtgcagaatgggaaaccaacccagctcaaaaggaatcatcaagcacaaaacatgaatcacaaccacattggctgatggatttcctctgtattttgctggtcctgtgtattagtaacaattgggaaccactgcatcagaacacaaattctcctctctaaaatgttcaatgactgaataagaactatcctttctatagcatgcaaacctggagcaagaaccaccaaagttccatcataagtatcagtaactgcatttgcttgcttattcctctttgcttacaggacaggtaatattctgatgtgaatatgattaaagaggtctttagcatacctgttgagtatttataccaacactacgtgcagcacttctgcattccagtacccaagtttgcgtgcctcctactattaaatgtcgctgcaaataccggaaaagcaattgcctcatcgtataacccctccaaacttcaccacacacgaggcaccacatatcagctgcagcattaaaaattagttacatgatataaaataacaggacaagtagaagccagaaagctccctaatagaccagcttcttagctaactaatgtgtagcagaatagcataggagtccagcactgtcaacatatttggtgcttaattttaaatcaggaatcctcttataaagcatgaggatacaactcccagcagtgaaagcttccggtgcaatatgatccttcgaaaacagataatgcatggagaaaataaagagcgatgagacaaacaaacccatggcatagggtacactttgctctaaatcaccactcatcatacacagctatgggtatgaataaatattctacaacagaaccaagaaggctaaaataaaagaaatcacattttgcaacagaaagaaagcaacttttaagaaaactagcagaaaacatggtgacagcgcaggcttgtgcaaacaactgagaaatgttccacataattcttggagaatcaatttgcagttagcacctgattgttcccataattcccttctcagattcgctgtggaacaagagcaactcactacacaatctcatcatcgaaacatgcagacaatttcctctctctttctgggattaggatcatacatttccatccatatttctcaaaggggctgaaaactaaaagcaaaatacattgacatcctaaagatacggtggaaggccacccaaagtgagcatatgatcccaactaatgcacacaaattagaccacaagctctgatcccaaaattgtagcatatcaaaacataggccaaaggagcacctctatgaggagcagcattgcttctttgcattgctgacatccgtggtagacacctcaatggtcctcccctctttgatgcctccagtaggtcctagtgaaggctctgaagaggacagaggcttcttactgatgattcgatatatctctgaaaggatcatctgaaaggctttctctacatttgtggcctcgagagcagaggtctcaatgaaggacagaccttccttctcagcaaagctctgtgcatcctctgtggcaaccgcacgaaggtgcctaaggtcagtcttgttaccaatgagcataaccacaatgttagagtcagcatggtcacggagctctttaagccatcggttcacattctcgaaagttgtggccttggtcacatcatatactaggagggctcccaatgcgccacggtagtaggcactggttattgccctgtaccgctcctggcctgctgtgtcccatatctgtgcttttattgtcctcccctctacctaaacattagaaagaataaataaaacaaaatattgggataaaatagttcaaagacaaacataccaaatgtcagctttgttgtcatattttgctgcttatgacaaactaaataaacaatagattctattataaagagaagaataatctgaattgagaccatagaaatgaaatttagaacaagatgagctgaagctttgttctacaaaagctcatggtagcaagcagcttgatcaacagaatgaaccccaatatatttgtttccatttgagaacaatcagtgaacatgaaaaactgactcaaaagatggaaaaaagaacatctataaaagaataagtccttcaaaaaaagataagcaacaaaaaaaaataaagcaaatttatattaatatattgacacttgttaggttatctttgcagatcacaaaaatatatatataaatcaaatattctgacatatcctaacgaaaatgtttctgaaaagcagataaataatacataaacaagtactaatttgaacaagagatgtcgatgataaaatcatgcacaagtttgcagtcatatctaattatgacagacaccaggataattttacacaagcaaagaaaagaagagagactccaagctcagaaacaattcatcatgaatcctccaaacagaagtcttgcaggttgaacaggaataaagttttcagctgaggaaaaaatcatgacgttgacctttcgagtgaaggaatattgtcactggttgatatggctaaaggcaaaggggtcccacattggtgacagatgttcaagtaacacatatttgctactcatgcaaatgaacttatgtttgtttcagctgaaactaatcatatagctgcacagaaagcttcatacataggaaccaaatcttcctactaatttttgaaaaacacttctacagacacttcaaatccagagctgatcaatagagagatgcatcaaaatggcatcacatattgatgcaatcttcgataatttcactcaataatatgtttggatgattgagcaaagcatcatttgttgagaattcaatgtcacacaaacttaactattctaagcttctattttctcccttttttttcatatgacagaacaatagtgaagcatatcttgtctggatgttaaatcagtctccatttttgttttatcaccttttgattaaaaatgaatcaatatataacattgatcatatttcggagtgttatctagttagaacatgagtttagaaaggagcttcatagatagcacagagtgagagatcacgaaaatgtagatgtcaccttgaattctgggatttgaatgccctatcattatgtgacataaagaagaaattagaataagtacaggaactatagtctagaagagaaaactatgacttataatggaactggaaaatagatagtatgcacatgcattgtgcatgcagatggcaacaatgaatcgtaatgctaaattctaaggaagagcatcacatgaagacatcactcttggtttacttgttgctccctattttaagggtggggagaaagaagacaaatgcaccaccaaaagtggaagtatatttatcatataaatactggaaaagatctttgatccaaaagggccatgggcattgatatttcctctacacatcactcttggtttacttcttgctccctatttaaaggtgaggagaaagtaagacaaatgcacagccataagtggaagtacatttatcatataaatactggaaaagatctttgaaccaaaaggaacatggtcattgatatttcctctacacatcactctcggtttacttcttgctctctatattaaaggtgaggagaaagtaagaaaattgcacagcgaaaagtggaagtatatttatcatataaatactggaaaagatctttgatccaaaaggatcatggccattgatatttcttctcacatgcattacagataccaactcttgtagtaaaaactacacctatgcctccaaattgatcacccattagacgaaaacccagttcttagctaagataatcttgtgacctgcctctaatatcactaaataaaaatactggcatgacaaactaaataattgctgaacattttatgacaagaatttagaggacaaggaaggcctctcagattattacttatatttgattatcaaatacaaatacatgcacatgttatacaccaagatttgcaatcttggtagcagatccatgacaattccatgttaatacagtatcaataaacccagtatgggtttggtttggcataccaacacttggtacactagccatcctgagtatcagtttgctcctgatatcatatgttacatccagtatcgggcagtatgtgaaagcatggcaaaccttgttatacattaacgaatagccaagaagaagaaacattatgatcatatcaatgatgattggttaaattcacaaatagctccagtgccactgtcacaaagttatttcaactaaaataaggacaacaacaatcaaatctacagttaagcctcctaaaaattacaccaaaacaaatgacaagacaaatttgtccttaatcaaccgctagtcaaatgggcatgtgcactgcatattcaatttatgttggataaagtaagaagtatcataaaaaataaatttctataacatgcaattttaacataaaacatttcacactataatttatgttatctggagaaataatagttctaatatttatctcatgctcataatatttttgataattagatacatcacaagaagtaaatgcaatgcataatgagaacacaattatagtagcagccatggttctgcacattgtttcttatgatagctttgagcacacctcaaaataataagtacacaatgattgctgtatatctgttatgacaattataataatgttaaacaacaatcatgatgcctaccacttatttaacctaataaaatgcatgaaatataatatttttctatatcgatatataaataaagtatatacgaaaaaatattgatatccaaaaaatatcatttatgtaataatattcacataccctcatgtcatgatgctgccaatatccaagtataattatgctggcctaaatattgatgcttaatcttttaaaagcatattttagaacaataaatgttactatattatgattgagatacttgtttcagatgtgcattttataaaatacttttacaacatattcttatataacaaccgttgattgtcttctatcatagtaaaaacagccattgtgtaatggtaatagcagtcatacttaatttagatcatctcattataagaaaatatcacttaaacttgaaatttagtgaagcttcaaaaaatatacttttaaaaagtcaaataaggtcatcataatggattaacaaagacaattataatgataagataatagttgaatatgttattttaatatattaagatagattagaaaattatatatttttttaaaaaagcacattgcttaaatctactataaagatacaagaaacatacactaagaagagctggaaatccaatttatatgtgatgtcactcattcctgcaatcagtttgttattggtatccaagaaattttggaaaaaaaaggactttgtgtggtatcttgcatggaatggaggaccaaggttttaaataatgtgttatattattataatggaccccacatccatactgtttttgaatgttatgacaattataatggcaattatttgcctcaacagtagacattcaaactttaaaatttaataataattgtttaacagttgctataatgatattataatatcaaaggaaataacaggaaaataacatcattatctttcccttcactttccactgaataaaaaaaattaccttttggagtgtactataaattctagacaaaaatttagtataaaattttgaatatcgaaaaataatattttatttagaaaaaagtataagcaaaaataacgaccattatttatgttatatcaaacgattataatggttaacaatatattgaaatgtttattttttactcattaatgtgacaatgggtggtcgaaaccattataatgggccattacaagggttataataccattattgtataccttggggaggacaaaaaagaaggaaaataaaaagatttaataacttgcacatataactcaagaagacactcagctattgtgttgtattctcattgctctttttaattagcaccatgaattgtgccccaaaatgaagtgcagttaatgatgcaaacagatgtcattttttagtgttttttatggattaccacatcattgttcagaagaaaataaaaaaaaaataaaattaaaactccagccagaccgactgcctgggagaggataaaagtatcatgaaaggaatactcccttcccacttttaaatatgggtataggatatgcatggatggcttcacttcagcatcaaatgtgatcagtgcattaattcttgaatgaggtctcctcattcttttatgttaacattaatcctcaacggtcatttgaaaaactctatcctctagaagaaagtcttcaatatgtcaatctccatgggttgatttcgtgacacttgagctgataatatgggcttatagatctcatatatacaacttgaaaagcaaattcttgacaaatgataatgatgatcatttagaagttgaaagaatacactagattttctttcttttatttgggaggtgagatacagaaaaggaattttgtataccatggcaagtgcaaggtcaatcatttaggcagaatcaagttcggcaatgaaataagtataagccttgaagcaaaggaagcgagctgcttgaaggaggagatttcaattattgacactgaatggacaattgcatgataaagaaaaatggtgatgatgctgtaatttacatgttttttttggttggagtctcttcaaatttggagcattactatctcctaaaggtccaattcagccttaacatgaacatttttagaaaggagtgaggaacaaaatcttattagcacataagttgaacaagaggaatcagtggacagaagcgccatacaattatttgtttaagatatggctagaattcttaccatgtgtttcaaattgttataaccaagagttcgagtcccgatgggacatcccgcgggacaccgggatggggcatcctcccatgtgttaggataggactaaggattcaggtcccagcgagacgtcccgtaggacaccggaatgaaataccatctcatgcattgggataggaccgtctcgctagcatcccagcatccgattcaggacatcttgggacatcctctatctcaagtgttgggacggaccaagatagtggcacgtcccatcccatgaaaaaattaagatagccctgtcccacaggatttaaaaccttggataggactattctactatcgtcctagtatcccgattggtatgttttgggtcatccctataccaaatgttagaatgggacgggatgatagcgcatttgttccattgaaaaaatgagatagcccattcccatgagatttaaaaccttggtcataacaacaacttatgaagaaatgtgaatatccattccctccttaacatcaagactatgtcatccaacaaatgtaaaaaatccaaaataatatttctggggaatgtctaccaaggcagtggagaatttgattcctttaacaccaaattcttgggagatagggaaaaagtccctcaagttataaggtataacatcaactggtaagaaagaattagattcttgagggcaaaaataaacagctttagtcttttggagcaatgtatcttggagtcaatcctctagtgccatgatgtccaatttaaatgacttccaatttcttatcacctttttctaatgaagaccttggacattcataaaagaagatttcatagaccaaaacactgtaaaccagctacaaatttttcttgaagaatatcacattgtaaaccagaccacttgcactatcaactgtttttaacaattcttctatattgtaacactctcgtatctccacctattccacagaaaaaaatatatcatacttcctaatttaattttaatcttcatccaatgtttaagataacgaatagctatataaagattttatagtgccaaaaaaagtaagcagtgtgctccttcagcatcgatgtaggacacaatcataatacctttacaatttcctacattttgtccaccatcaatgttgtgtgaataatgtacatttctataaccttatattattatatagactacatctgctcacaaattgcattggctttatgagctactgaatcagctcactgtttgttgtgaattccacatgttaagtcactaaaagagcattcccttccatcatttaaatgccatcgtactagttttacacaaagaggttaacaattaaaaattaaggatcaattccctaatcaataaacctttggagaccaacaccaagcatcttttctaccataaatttaaaccagttctcctttgagtgaggtcccaaaacataggaggcatctattagcatggttctcagaaatctagcatctcaagtatacaaggcatggtgagtaacaactatattcgtgcttatttaataaagttaggggattcaaatggtcaaacaacagtatgaagaatcccatgttattattacaggtaagccctctaacatatcaaaattggtgagaatgacattgcaaatacactggagaagagggcagaggataaaatagtgaataacagaccttcaaatgtcatgaaaccacctatatgtaagattcatgaagtgaaagacaagagaacaagccattgttccataccaatacatttcaaatttatcattcaccatccttggagtttatcatcgcatctttgcaattattaaccacatctctaccttggatgtaagattcttcatttacacaccataaattaatcgcaaaaatagatataaataaacaaaataagaaattgacttccaagtagaagaatgtaaaaagataacggtttcactttgaaagggcataacttatagacttctttctcaaaatccaccacttttatggaattcaagaacatgactggagaccttgaacacatggtcctttccatatcaaaaaatggttaaatggagaaggaatgcatgaaaaactaggtgatttagcttcagcactctttttgaagtaatagtttcaacattagaatagatggaagaagggtacaagaatcccaaaggttcgtcagatataaggttgtcggtaaaggccccatcttagaatgcacttaacttgaactccataagttgcaatcctagggtaaacttatttcgaagttgaagagctaataatcacgaaactagggacaacctaaattcatgttattgcatgggtaaggattgtaaaagcttatgtactaagcaaatcaaatcacgatttctaattttggaaacaacaagttcttccatatccaattccatcaaattgcatttaggagaccagagccaagaaacaagtagggaaacagttcttcttttgtttggaaaattaaaatcagatcaatcattccatgcacccagaacaaaaagaatgcacgaaacattgacgattcctgatgctcatatgaaaggggcatggagaaattactcccaactaagcccaaattcaacaaaatccgaaactcacggccaattacaagagccaaaagaaaccccaattggagagatcaaagagaaacccagagagaaatcttcgaagaaaagaaacagatagagaaaaaggggcggggtgggaatcactttgagggtgcgggtggcgaattcgacgccgatggtggacttggagtcgaggaagaactcgttgcgggtgaagcgggagaggaggttggatttgccgacgcccgagtcgccgatcagcaccaccttgaacagatagtcgtactcctccgccggccccaaccctcgccgcgccatcgctgtgatctctctctctctctcttcgtcgagctccaacaaaagtccgcagcagtagttacggatgacaggtgatgatagggaaagaaagagagaaccatttttaatcatcctaacgaaccctgcccaaattccccaccttaaataaataaacagaaaaaataatgactgcaaatctaggcctccctttaccctttttggtaacgaggtaattcattttaccagttaaatgtattttatttttaaggtagcattatatcttcaaactatatgatttgacttttttatgatattaataatatttttgtattattatttaaaaattaattaggtataattttctcaattggttattgatttgaaaatttttaaagataatttttatttaaaaaaattaaagaaaacctcaagagaacgagagggatggcttagttgccatcgatagagaataatattttaaattaattagtagtaaaaattcaatctctcaatttttatacgatactatttaaaatttattaaaactatagaatgctaacacataaattacatttgttcgaagataggtagcttagataaaatacatgaagttaactataaattaaattttttagaatcgattacaatcaaaaattttgatttcactataatataattgaaatatggtgcttcttctttatcatattgtttcgattttaattcagacatgttatcttaaactctaatgccctccccctctctccccctcccctccccctctcgtacgtcgtacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggttatattactctgtagcccaaagatgtgtgtataaggaaatctggaagctctctatgagtatcagaagttcatccgaccaaactccatcatgttccatctgtacctcactgctacatgatctcactcctgaccaaggcatcttatgcttagtttcttatacattctaatgattgtacctatttttatttttaatttgagacttgtctcccctagtataatataatataatgtagtgttgtatacttgtaccataattcacattggataaccaatgctccctggccctcattgaggctttacatgcatggtactaccgaaatagtcgccgatgaaaatatataattcaaactcaactgattgttttaaaaaaataataaattttatttaaaatctaaacataatctatcgatctaaatatcataccatactgagcctagatagttaaaggtcagaatgagtcattggttaactcaatccatttgcaaccttattcagggcccgaaaaatagtttagagctaggaactcattgtgcccctctggaggaagaattgaatcacacataaggtcaaattaaagtcaaccacatggaagttagcagaggtcaaaatcccctacttttgcagttcttttcctcgtacatcactttggttgcatgaaactactcctcaggtccatcaaaccccatcctactcttcttttcccttacaaccataagactagttgctagttttgctcaaggtctaggctggcaagctgctttatgttcatggggtgcgccacatcagtgttgcccctgaaggcttcccttgccaatatgatgttcacagctgcagttgggtggaaggcatcccaaaacacatactgatctctatcagagcatggagtctggaagggaaggcaggtgatctgcccactgttgcgtccgatgccgcagcacccacggtcgaccacgctgaatcctgcaacattaaggaaagatatatacaagaattaatatttagttatataagaatgagattgcaatgttctgctaccttcttggatccaccctcactgtgacttatttggctgtatcttttgttctttatatgtgttgtttcattatcttcaatgaaatgtggtttggccttgcccaactctctctcattcttttttggtgttttttttcttaatcttctaattattacatatagcattttagttatgactgcagtaaaaaatatagaaaagggctaatgcccattttaaaataaaatcatgtacatatataagagattgctaaaagattttcatattattttgaatgaagaataaaagcttgggctatcttattattgaaggatttaaggaaactaaaagaccagacaatcaacacaaaccagtgccattcaaatggaagcacttaccataagatgtgggattactgaggatatctttgatcagccggaagttgtcaatgtatgtgaacttggcaccacggaggtttacattgaggttgtcaaccattaacttgacattgttgttgaagggaatcacaagattatcaacttcaggtgagcaatgacttgaaggattttgtgcaaggatgcttggaatacaggccattgatcctactccagcgatcacaaacctccgagctccaatgttgtataatctctacaagaaagcaaaacattgttctttttttttaaaaaaaattttgagaagatgcgttttcctatagattcatttcatgcgataactgaatgactacaagctgaactaaaacagaacgttttttcctttttctgatgagaactgaattagaacagtcaagtgaaacaaagaaaactaaaacaatcttaatcataagccaatttagcagttgccgaagtgcatctcgaaatatcttcaggttgcagtccacaaaccatatactaaaattatggatgttttcattgtctagctaagcttcccttgatcaaataagatttcacctctcttattattattttttttcttttagaaaaggcacagtgcaaagaacagtggcattaagaaattgaaaggttgatgctaagactgaaattaactatttcaagtagtcaattagtccttctctaacaaagattccattcaaagctctctctcctccccctcccccctcccccccccccccccccccctcccccctttttcttttgagcaaaatgctcattcaaagcttgcaaggctggctcattggccacattattgcatggtactcatgaagcaaggacatgagcttgcagccacatgattctttagcagttgctgtgcatttattgaatcaaagttgggtgatcaataaactgagtccttgattaatttcaaggttggcaaattacccatcacatggttactaatccaatctaaaacaatgggctctgtgacaaaccaacttacagtgagttggcgggtgtactgccggaccagaagatcagcaaactggtcggcattgtacacgtttcgtgtattatagttaggcatcagatagttgtttaggtagtcattgctccccattcccacaaagaagatgcagtgagctatggcattggcaacatgatcagctcctaagttcctggtgatctgatcaagcgtcgactcgaagttcctgatctgctgattgaatggtatcctccccacctgtgtcaccatttttggtgaaccatcacagagacatcagtgatgacgaatagtgtaatctagcatgcaagaaagctacctaattagatggttcttttagggatcaagagtgtagagggcttacaaagtttcgtccagtgatgtctaaaattccagcagcagccgaggcatagttaacgccatgaaggaggccttcaccagaagcttgggagtaaggtggaataagaggcagtccaagaagatcagctgcaagagaagacaaaggatgactcaataatttgatggtgtcataaacttagagctgagcaacaaattaataaggcacataacctgcacacttcatggcaatggcagggtaattgccatgccttggtagagatagattaacaataataggagaaaaatacatgaaaactggtgcacactgcaggcaccataagtgcatggagtgaatgatgagacgaggggacaataaatgcagtctacgaatgtattaaatggagaacttgctcttataccttggaattcgagactagaccttattttcctttgaccaatgtagtcatagaagatgaaaaattggtggatattagagagtattattaggcataaactcgaaaatttggtggaaattaattagcataaactcatcatacttcttattggcttaggctgctttttgttcataatttattatacataaatcaaccttagacatgaaccatggaggattcaaagcaaagtgtgttccaacaggatcaactttaaataaacaatggtaactaagtaccatactttaaatacaatgcgaggaaagagatcgagtaaagttagccctatgagatggagactaaaaagtttgatacaaaaatccaaggcacataaaagttaaaaaaagattttagtatttagtgtgaattatctaatctcgatattttatcaaaatctaaaagagttgggaagtagcttagtctagctaatattaattatagaacaagtttgatcactagttaataattaaaataagaaagttggtttcatcatgcatgagatttcaaataaaacagctgaatgggcatcctccaaattttgcacccgagcggtttgaaagccatccttcactcagggagaaaagaagttgtgaaaaagctttcggctcctcccaaagccccaccaccacccagggcttccacctacatgctttcatatcaacacttgtgacccccctgtgaatggtgtggtcatactgaaggcaagccaagtcacaaccattaaagacgagaggtttagaggactcgcctatctcatccacaatggtgtagccattggagaacctccctgtgggtccgccggcgaagtcgatgccataagggtagtagttggccttggcaaaggaggggatgttgttgttgttgccgttgtcaataagggagtctccaaacacgaacattgccggcaccaattcccttcggccattgccaccatctcctggtgcaactggtcctaccactctttgagctatagaaaaattagaaactgttgataaagctaggacaacatagaagaagaacatggagagtattggatagctaaaggttgccatgtgaactggatacaaggtggggaagaaaaggagatgggttgatatagaaaggggaagtggaaaaggatggtgggtagataagggtggtaatcaatgcattttaactgtgctcttacagaggagtaaatgggcatgtgggatggagtgcagagaaggtagagaacagtggtgtttttggtattttactggaaaaaaaaaaaatctatgacaggattgtgactagaggacgtacctcccatttaaggtccttggcaaggatttcctgtcgatttctttgaaagtgaacgataggcaagttccaagaaagaggttaaggttcttgaatgctgaatttgaatggtagtagcgtcataggctcgcaagttttagcctagaaagtggaacttgatcagagtttttttattagaaaaagggaaggaattaaggaaatctcgggtagattcttgtttgacctgacgaatccttcatgaatctagctttggctcgtagatgatcctcatctcatggatcaatgctggggtaactcaaaaaggtcattcaggtgttttgatccagtatcactttgcttcatcaagtggcagacgacaataattcaaaggagcaataagaatacactccaccagctgagggaattttttgagtcatctcagtaagatgaacaattatctacataatctttttccttttgattcatattttagatattggagaccagtataaagagttgaataacaagaagagcgaaatggctagtatctaatattatagctcaagtttcttaacgctttatttcggaagttgtatatgtaactttcgttctagggttctagtcatttgttactctgttactggatctcttttatatgtaacagaaaaaagaaaaacccttctggttcttgtggatcccaaatattgatcaccttactacacaaaatataaatattctcattatttgcttttttttagtgtaatttttgcttactacccaataaaaatatggataaaaagaaaagtagactagcctaacatgtccaccaaacaaagacacgcatcattacttatgcacccaaacatggatatgagccaaatctaactagatttgttttctcacagaatgagaatacactattaaaattacctataacaaatgttttattagaaaataatacctccaatatctaggctcgatacctcttaagtaacaaaatggctcatgcaatcattgagctataaccaaccagattgaaggattctcacttgatcgtagttaaatttttgggtgattatgaaaacaatcagtaaccatcattggactacttccatgaattatggcttaggcttggaacataataatcaccttgcaaaagattttgttagattacttggtttccggccattttttaaacttgaatgctgtggccatactcttaagaatatcattatgttttttctgaaaatatatgtggtgaatagaatctttaagaggcaccactcgttgaccacgtcttccggccctcggtctcctaaatattttcacgcggaaaccgtccagttgtcagagaggcagcagagacatggcagttgaagtgaattatgagctgctgttggaaacattgttgcaagtcaaacagaaataagtttagtcaaaggacaagttgacttcggggcccgccgttgtgttgcgggtccatgcatggatccaaaacttaggagcactattcctgggaaacgtgggtccaaatttactgacctcttcttataattgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgggcggccacaggcggcggcgtgcgggacacgcgacccaggtgtgtggcccaatcgggtgcgtggcccagcccatgcgtgggcccacgcacgggtgcggtccaggcccgcatgcgcgggccagcccaggcccagaggccctacctcagccctgtgcctcggtccaccatggatcgggcggtccacggctgggcatgtggaccgtgtgggtatttttcacatatttcacgcggtccacgatactatttcgtggatcgaagcacgatcgaagggcccagggacgtcccgatcttgatccgacggtccagaaggttatttgactttgtttaggactcctaatctatctctaattaggtttaagccctttaaaagggcctgtgacgaacagtgaacagcagggattcgaatttttgctgatggtgccgcatggaacccgagaagagaagaaaaagaaaggcgtgaggccactgagagagaaggagcagggctcctagacagcggacgccagacatttcaggggttcagggggtcttccaagagagaggagagcttctgagaggaaaacttttagagagagagaattgggtgtacaaaggttgagggtgaggtctcctcttgtaaattttttttttcatagtgaagtttgcatatcccgtgaaagcgagtccttttgtggctaatccacgtattttgattattttgttttatttcttttttcttcctgctgcatcgcgtggtactgaaaaggtcttgggaagtggtgtcctggccagacatccatccaacaactagaaaagtaatttttaggatctggattgtcaagattagctactattgtgaagcttctccacctaaaaataatgtatcgatggagtaatgcatcatttgatgcattagttgagtttttgggaggagttaatttcaagtgctaaggaggagattcctaattccttttacagttgtcaaaaatatatatccgatttagggttaacatgtgttaaatataacatatgcaaatataattatgttgtctattgaaagttattgatcgatgcacagtgttgttctattttcaaattatctagatggaaggacagtgaagaaataagtataagaaaaaatatcccacacaagatgctaagatatttttcaatcaagtcaagattacaaaagttgtatatgtcacctaagattacagaacatataaagtggcactataataagagagtaaaagatggagaaatgagacatccagctggtacaccagcttgaaaatctttgatggtgaatatgttgaatttgcaaaaaatctgcataatattcgattggatatggcaatagatgggttcaatccatttagacaaatgagttctcagtatagtatttggtctgttattcttgttccatgtaattttcttcgatagttatgtatgaaacaactttacatctatctcttgttgttaataccaggaccatatagcctaggaatgagcattgatgtgttcttaaaatagctgattaaggatttgactgatttatggataaatggagctaaaacctttgacgcttatacaaagaataacttcagtttgcatgcagctataatatggatgataaatgacttttcaatatatggagatttgtttggttagtctattaaaaggtatatgatatatccaatatgttataaggatacatatagttgatacttgaatgaagcacaaaaaatgtgttatataagatatagaaggtttccaccacagggccataagtgatgcaaggatgtagctcatttggatgggactattgagaaaagagataagcctaaaccattgtctggtgcagagattttaaagatgctagaaaatctggatcaatagtcttttgggagcagaaatgtgagagctagatacaatcaatccaatactatttttaattggaggaaaaagagtattctttttgaattaccatattggaagactttgttaattcgtcgtaatcttgatgtgatgcatattgaaaaaaatatttatgaaaatattatggagacaataaagaacaatgctggaaaaataaagaatacattaagcagctgttatgatcaagttgaaatggatatcggacctgaattatatcccgttataagagagaataagatatacgtgcctgcagctcgatattatctatctaatgaagagctgatgttaataggtctcaaaatacctgatagatttgttttcaagttaagtaggtgtgtgagtgaaaagaagcaaaaattttttgatatgaagagttatgattattatatgtttatacagtgattattaccacttgcagtgagaaattttctatcaaaagaagtttgtgaacctctcatatcattaagctttttctttaaaaacttgtactcaaagacattaagtccagatgatcttgatcgtcttcagaatgaaattggcttaacactttataagctcaaaattatatttcctcctttattttttaatgtgatggtatatttagtcgtatatctcgctgaagaggcgaaagtagctggatctgtataatataagtggatgtattccattgaaaggtacatgaggaacctaaagttgatggtgagaaataaagcatggtccgaggggttgattgcagaatcatatattgctgatgaatgtttgatattctgcttaatgtatttgaaggaagatgaagtttaatcatccttttaggtacaatgataataatagttatcattctggtcatacctcaaaaatatttttttcactaggcaattcaatagaagctgtgaaattcaagactttaacacatgacgagtggcataaggtacaattatatatgctaaacaatattgttggtattaatagttttattgagtaagttttttatcaatcatatttttcaaatacttaattttttaaactgatgatatcttataaccattatagtaaaatttatatgtttgttgatttgtacataggttatataaaagcatgttgtcgagcataagtcatcctcaatttatagaaagatataatactgaattttctgattgatttcatagctatgtaagtattgaagggacaagttataagtgctagatatcattagatgcaccaatctaactattaaaatacaatatttcttaggtttataaattacatcgacaaaacaatatctctgatgatttcttttttttggctttagattcatcatttgctttcaagatgtaccatcgatttgatatcaatgattatcatttttatatattttcaagagatcaaagtatgggatctcaaagttcagaagtactttgtaggagagataataattctatgaaaaaaaatactataggatcattgatgagattaggagttgacttatcttggatcaaaatatgtatatctttttaagtgtgactgatataatgtccaacatctaatgtataaatataaaattgataagtttgaaattataagtgttaatattaataagcgtttaaatacaattgatccatttatcttggtccagtaagaagaacaaatattttatatctcagatcctaccaactctaattgggcagttgtaataaaaacaaaatcaatgaatgtccatagtatttctttgagtggagatgatacaaatgatgacaatacagaaattgaggagatctatcaagaagaagatgtagatgctggatacatcaatcaactattagataaagatgatcatgttgatatacttagtaaggatgacattgttggtgaggaagtgccactttcactggtcaagaagattgaagatcatattgctcgtccttctaaatttaaagatgacatatttgatagtaataatgaaatggggttggaggatgtagacaactataatcaagccaaaacacaaccataccttttagaatcagaataaatttattataattttttctgattactttaaataggtgtgcaattatgaaatcttatgctaattttatatctttgcttgtttattatgcaacaagtatgcaattaaagaatcatgaaaacttatatcagtttatgcctttggatttaactaactatttttgcatctttgcctcttgttatagaaatggctccaaaatataaagacatttcatgtactattctcatggcttggtaagatgaggacaatgcatcagtgagacaacaaggcagtacaggtctagcatgcaataggtagggacttacatccaattcaacaactaggtagagagctgtaggccttacatctagacctagaggtcaaacttctactgtacagccatcatttcaagttgtcatcagacacacatctagcatacaggtatttaactttatatgtcttactctaataaagagataaagttgatgccatttgctattttctttatttatagagaatatgtcatttgcaatctcctttgcaaagatgtttgaattctaggattcctattgtctatctctttttatattttaatttaattaattttgaggattggaggtgtcgattgtctgtcattttttgtgtatttttttaaaaaaatatatatctttatatgatacaataatttgagttattgagtatgtggcagccaagtgaggtttgagatcaaagtattatttattaattttaagatttatcctcttgctcacaacaataaaacaaactattttataagaaatcaaattaattctacaaaatttaggaaccgaaagaggtcatggttaataattctttttatattttcttggaccgtgcttggttggcttgtttttgctaggttatgttagtaatttagtatcaaacaaactatgactctcttgtatctgtgtatgtataaatggtgtgtacagactgcacatacacgaaaaggattttctcatgactacatattctgcattcacagttcaattatttttttgatttttgactttctcaaaccaacaaagtttactagaaattataaaagatggatgtggaacacagtaaacacaaaggtttaaaaaagacaagagcttaagccagccagacaatgtactataaagaaaaagaagtctgagtatgggacatacaaggcaattaatttagacttaataataaatagagacgagaacaatctagtcatagcaataccacctaaagactttattacttttataggaaagatgcaaagtacttggaccactatcttggcaaaattgtgagagattatacttatgctccaattggggtctagttgtctgctaagaaagagaaaaaatatgatatgagaagaaatcatggtaaaaaaaagtctatatcattaattatattgcttggttgttttgttctgtctacactattatgtttgtttgattaatgctacatccatttaagtttctatcatttatataagttctttatttatattatagaaatattttatggttagtccttcaaagttcaaaattttggaagaaaaggatgacatgatccctgatacaccagaggtaaagtaagaaaagttttgcagtctttgcttaatgagtatgggtgcaagctttcatcgatgaaagtataggctctatcgtgagtattacttgctattcaaaatagcagaggagcagtgagctacagtacctgacggcacctgacttatggtacaaatacattgaaaagtatgagaaagagaattttcaaatcaaatctaagaaggcatctaaaagtccatccaatcaagtaatcatatctaccactaggtcaaaattattttatcaaaaggagtatgaaatgataagctgttcaaattgttgtattacatcagctctgagtttacatgtgtctcttaatttttcctcataaacatatgatagatgaatcttgagactagtgagatggctaatccctgtgatgtatgaaggcaaagcatcgaataaaaaagaccgtattatgatattatgatccaaaattaaaggaagtatatgtgaaatttctttacttaatctttggttatgatctaaaatcgaaggaatcaaaatattgcatgcctgtactatattgtacttaaaagtatttcaatccaatatttcatttctttaaactagatcataacctattgttgcaagggtgcagaaggatgaaatagtcggatatgtatacatatcattgtttttttgacaaatgaaaatatgaaggtcattgcatttgcttgaatgatctattgacaagaacttataataatcaattgttaattctcatgcagtaaatttttctcatccaatttgtatgaaaaaagtcagatattgattcattctttattattatactttttaaattttttatcataattatatagtattttcatataaccatataagcagattttagtcaagttcttttcttttttgagtagtttattcctttatactttcaaatatatatttgatatagttacccttgaattttatttttagaaaaagttgaaggagtttggatcccaacccacacaagaaggtgagagacctttacatagggatgagatatatgcacgcatcttagggactcgaccatacttatcttgaagaggggctggttataagttaattataattgagacagcaaagaccattcacatatcatgtgaagagaaaatccatgaagaaaaaacatgtagatatgcaagcaaagttacagaagatgaaagtggtcgagggatagctaacagaaatggtaagtttaaaagagaggttgcaacacatgaaagaaatgatgcctcacttcttattgcacaaaagagttaaccctctatcaaatgaatcaaatgaagttgacaatgactagacagaagcaactagcgattataaagatgatcctatggaggtaattgaatgcatgatttttttttcatttttttttgtagtttggttggctaacatgatttagttacacactattggtgttatgtctctaatttaattgtcatttgttatttgctattcttttaggtgactgttaaatcttaatcgaaaactcattttttggtctgttagtttttgccattaacagtaacatataggagttaatttgtaatacccgatccatttgggccgtggatcaggcccaaaatctgagaggcccacaaatctcacaaaaaaaaaaatgaagaagactccctacgggagggtcgccgatcggctcctaatcggagttggaaaacaccccggagaggagtcaaacttcttcccctccgaccttatttaagaaggagatctcttctctccccgtcccatcaagaaatttagagaacgacgaggatcgtcagagttttctcgtggaagtccttcactgtgcttgccccaaattctcgtcggagatgtcatcggagctcaggtaaggcttcgacctttcttcctctccctctttcctttctctccaaggctttagacccttatcgatcatcgggatcgttgaaaaatctatgaaaagatgaacccctgttttgctctattcgatcgagccatcttcctctctttttcggccactgacgccgtcgtttgtggtatttcatccttaggtttggatctctacctctctatctgtcatcttcaggaggctttggccgccgacgaccagccaatgatcgaaaaacaaaaggaaaaggggcatgtcccttattttttgaatattttttaaaatcttccatcgatcgaactttgctgccggccatctcttgccccactgtcatcgatcgccactatcggaccttcgaccataccatcatgcctcaccagagcacaagccaccccttttttccccctcgtgtctctcctctgttcggctagggaaagaaagaagatgaaagaaagaagaaaagaagaagagaagaaaagaaaagaaaagaaaagaaagaaaaaaaggagaaaagaaaggaaaagaaaagaaaatgagagagtgttttctctctcttttctctctcctctctctattttttctctttaatttttctctagattctctctctactttctttctagaatttctctaggatctttttctttctctaattgcatcatggaccataggatgaacttgagatgaaaataagatgatctgagattgctttgaaattcatgcagtaggttggatctcagtctgatccttattcgaaatttataacatcgatcatggttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacctcatctaaaggatatgaagattctctcttcattttttttctctactttctctctctaaaatttttttctctaaaatcttctctctataaaaatcttatggactagtggagggtccagatacttaaacaaatctcaattttggctaatcctaggagaggtcttggatttatgttattaggatcgtttatccgtaattttttcatatataatttttatatttaatcttgatcatgtagagatgtaattattgtacaagaagatatggagcaaaatatcttaattttggattggtaaattaagaagctcatcgaattctgtatttagatcgatcatcgatagagataagaatttctatacatgatcaccattatatatgctatcattggtattgtatcattggttttgtattgttgaatccgtgatcgatgattttgctatgccagagacactgttatttgcttatatgatttttaagtgtgagtatggattatgtcaatatatataaattcatgattgatggcatgattatatgtgcatgatatatctattttgattacattgtaaattgaaattgttttaataaaatcaacatataacaattagataaaaaggatatggcttgaactagccttgttatgtaaaacagcctccacaggcttatacgtggaagaatttgatctgaggaagatcgtggatattttgatctgagaaagatcatagatattttaatctgagaaagatcatgaatatttcgattcgagaaagattataaaagtcgatctgataaagatcgtcacatgatcctggttagtccaaagctagaaaaaaagattaaagatcatgtgattctgaaaagagaaatagaagacaagacatgaaattaatgctgaataaaagtgtttcatccgttaacatatgatgatgcatcttttttgataagacaaataatttatggatatttacattattctggatattgatatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacaccccttcatttctctttttttttctcagagttataggaagctcatgattggctatggtttgaatttgcaagtgagcagatgaatagatagagtatcattgatacctgatcagataattaaaaatatttaatttataattatgtaagttttactaattattattgaaattagacattatagatgttgaggttgaatgaattatttttgaccttgcatattctttagggcttgctctaaggagtgtgcggccattacatatccgatccgaatgttgggttcgaggtatgatagagtagtatcagagcttagattataatcatttagtgactatgatataaatgattaggatatgatagaataatatcagaacctaggtttaagatcactagagattatgaagtgagatcaaaactttatgtaggatgtaacagagtgatatcagagaatatgacttatgtggtatcaaaactttaagatcactagggactgtgacataagtgatatcaaaacttcaggattataattaatggagtatgatagataatatcagagcttaacattatgatcattaaggatatgatagaatggtataaaagtttaggttatgattacttgagaatatgatttaagtggtatttgatcttaagattataattattcaaaattatgatcttagtgatatttgaacttgaggctatgatcatgaggaacaagatagatataaaagaaaagattcgataattagatttcgaatcaatagatactatgatgaaatttatgcataagtggcatatgataatagaattgacgagttatatcttagatttcaattagtagggttgacctaagtatgagaagtgttgatcttggaatgaagagagagatattgatgtgttgtgttgagtatactcaataattttagaatactaaatttatataggtggagattatgataatttttttaattttgatgttaattatctgatcattacaaattttggacttatcagaaggaagttagttaggatgtggtctaagaagaaattacatcatatgagagagaaatatttttaagcgttgaatctataagaggtcatatatgaaactcaatttagataaaaaaatatatttagattttatgagaatttgagatacacgtcttggtgaaatctttggttactcaaagtatcatatttagacctgatttcttgattttttaagttgcattgaattttaagtcaaaagttacttttctaagtcgatctaaggtattttgatattgttgtcaaattgaataaaaaaaattgatctaattagaatatgatatacacgttatgatcaaatctttaataatctttggattagattctttatttatgtaattcaaatcaaaattaaaatttctgagctgatctaaggtatcttattattaaattttggatgatttatataagtcttaacatataagggggataagattttgcatggatttatctattgatgctaagggttgtgataaagggagctttacaagaaataactaagttgattctacttacaaagatgttgacttgagttcctctagtttgttcaagttgaagttaatttttttgccaaaaaaaaaagattggtttgaaagcttgtctaaataatgataagataaatcgaaggttaactcaaattaattctagatatattggattcttgaggagtagtgaagcttatgtaatgagttcaaacatagaaggtggatgaagatttaattttgatgtgctatgcctaagagatagtaatgataaagaaacttaaaaattttatcgtaaattttatataaaatttaaaagtttgatctacctttgattgatttaacatgcaaggatatttttattcttgatagacttatataatttgataagttgagatcagagtgtacagtaaaagcatgatggtttaaaattgattagaaatattaattctttaaattaaaaaatattatgaaatacattagttgtaaataaggaagaattttattgaaaatgaaaggatactacagattttgatctaatatgatcatagccagataatttttgttaattgattattttattgtagataatgcctagaagaatcctagacatctcaagtttattgttaatagcttgatagtcctgttattagtgcaaacctaggatgtcttgacaccgatatcattttttcaaaatttaactttgtgactcgaaatgacataaaaggttaagattttcttaagatgaaagtctacctattaaaattattgaaaggtcaagaaaagaaagaaatcgatgattgtgaagagtgtccaatgttcgacctttttttatttttacatcataggtagtttaagataattatgaatatcgagtggaatgtattggaataaatacctatggtatgttaatacaagtataaaatattattgctttttgaaaaaaaatcaaaaaaaaaatcaaaaaaaaggggggacgatgaggtgagatatcaaataattttgtcataacaaggtcatgagaaataaatagtgtgtaagatattatcgaaagtgtgaaaatgacatgaagcatgtatattttttttaaaaaataataatatatctcaaacaacgtaacttaattttgaggatgaaattatttgaaagggagagaatgtaatatccagcccatttgggccttggaccaggctcaaaatctgagaggcccataaatctgacaaaaaaaaaataaagaagactcctgccgtagggagtcttcgtcctcctgactggcccctaatcggagtcggaaaacaccccggggaggagtcaaactccttcccctccggccctatttaaggaggagatctctcctctccccctcccattaagaaatttagggcaaaatgatgaggatcgttagagttttctcgcggaagcccttcaccgtgctcgccccaaattctcaccggagatgccactggagctcaggtaaggctccgacctttcttcctctctctctttcctttctctccatggctttagaccctccccgaccatcggaatcatcgaaaaatctatgaaaagatgaacccctattttgctctgtttggccagaccatcttcctctctttttcattcaccgatgccatcgtttgtggtgtcttatccttagatttggatccctacctctctacctgtcatcttcgagaggttttggctgtcggtgattggccaatgatcgaaaaataagaggaaaaggggcggatctcttattttttgaatattttttaaaatcttccaccgaccgaaccttactgctggccatcccttgccccactgttgtcaaccatcactgtcggaccttcgatcatgccgtcatgcctcaccagagcataagccacccatttttctcctctcatgtctctcctctgttcggttggggaaagaaagaagaggaaagaaagaagaaaagaagaagagaagaaaaagtaaagaaaagaaaaagaagaaaaaaaaagaaggaaaaggaaagaaaaaaagaaaagaaaaaaaatagagagagaattttctctctctttcctctctcctctctctactttctctctagaatttttctagtatctttctctctctctaattgcatcatggaccctaggatgaatttgagatgaaaataagatgatctgagattatttcaaaattcgtacaatagattggattccagaccgatctttattcaaaatttataacatcgatcatagttaatctatattgagtcatcctgatatgacctctgatgatctctatcatgattgcctcatctgaaggatatgaaaattctctctagtttctctctctaaaatttttttctctagaatcttctctctcttcatagattttctctttctataagtcttatggaccagtgaaaggtacaaatacttagacaaatctcaattttggctaatcctaagagagatcctggatttatgttattaagatcatttatccgtaattttttcatatataatttttatatttaatcttgatcatgtagagatgtaattattgtacaagaagatataaagcaaaatatcttgatttcagattggtagatgaaggagctcatcgaattctatatttagatcggtcaccaatagagataagaatccctgtatataattatcattatatatgctatcgttggttttgcattgttgaatttgtgatcgatgattttgctatgccggagacaccgttatttgcttatatgatttttaagcatgagtatgaattatgtaaatatatatgaattcatgattgatggcatgattatgtgtgcatggtatatctattttgattatattgtacattagaattgatttgatgaaatcaacatataataattagataaaaaagaatggcttgaactagctttgttatgtgaaacagcctccacaagcttatgcgtggaagaatttgatccgagaaagtttatggataatttgatctgagaaagatcatgggtattttgatccgagaagatcatagatattttgatctgagaaagattatgaatatttcgatctgagaaagatcataaaagtcaatccgataaagatcatcgcatgatcctggttagtccaaagtcagaaagaaaaatgttaaagatcatgtgattatgaaaagagaaatagaagacaagatatgaaattaatgctgtataaaagtgtttcatccgttaacatatgatgatgcatctcttttgataagacagataatttatggatgtttacattattctggatattgaatatgagattttatgttttattgcctatctttattttcagattatattattatattggtgtgatatagaaatttttactgagctgtaaagcttacactcctccatttctcttttttcctttcagagttacaggatgctcatgattgactatggtttggatttataggtgagcagatgagtagatagagtgtcattgatacctgatcagagaattaaaaaaatttaatttataattatataagttttactaattattattaaaattagacattatagatgttgaggttgaatgaattatttttggccttacatattctttaagacttgctctaaggagtgtgcgaccatcacgtattccactcggatattgaatttgaggcgtgacataattcttatatctttttttgtttttattttatttatatcaataaatatggcacaatatcaaacaaatatctttcagagcctccagacatatgaaaatggatttcgagttgtgtatgggtcactagttttgagctaattcaatgttttctttaattttagtttgatgaatagcaaccaacacaagtggtagatgtgttggcttgtgtaaaaaatacttagcaaagtacttggtaagatcaaagtgcacatgcatgtttggtgaatttgaatatgagttggtgaatgagaaactaataaacctttcattgttatgtttatgtagacttagatcttttggtacaaaagctttttggatagatatcaacctcaaatattatgatttttttactatatattatgacatgtgtatgcatgtgagatcatgcatgaatgttgtttgagcacttctaaattttaaagatatattttagtctattggtggatttggatatagacttgataactttattttttgaagatttctgaaattagtagtttataatatttgaagtttaatatttctccatccttatttgttgaaaagattatttatgtatgtcattaaattgaatgtttgtgtgtatggtttataatgttagaaatttttgtgctcgattgaaaattcaaaattaataaataagattttaaaaatattttaaaaatgattgatacgaaggtttctcaatataggaatatttttaaaaatacccatgaaaagccattggaatgggtacaaacatctttatagatttttaaaaatattacaaaatatttctataatttattaaaaaatatctctgttaattatagggaacattcttaatccattagcatcaaatcaatggagacttttagttaacattgttgtaagtctaagagaatatttgaaaaatattcctaaagagccgtagggatagtttgaaaaatatctctgttaattatgaagaacgttcttaatctattactatcaaatcaatgaagatatttagttaatattgttggaagtccaagaaactatttgaaaattttttttaaagagctgtagagatggataaataatatgattgaaactcgcatggaaaacaattgaacataacattccaaaagaccatttaggaatggtataagccattaccaaataattttactacaaacggttagaaaacgtgcctaatatatgtaaataatgttctcaattacttttaagcatacgagtatggctaacggacaaataatatttctagaagcttataagaatgatttacatattttttaatatatttttggaatgtttttaaagcctttattttttgtaatattgattggattaatttatgtaattttttccatgatcacataaataatataacatatgaatatatatggagctatacaaaaggtacatgagcactcctacaatttaatccaagtgaatagagtagaatattaaatatttaagtactaaaaattatatctataaagtagctaaggtgtaatataactatatggattttctccttcactaaggtgaacccctcacactagcaaccatgtataattccttcgctagcaaccaggaatccacttcataaaacatgttaggatagagatatgaactaggtctacaagcttataattgagttgaaaaataagataccttattgcatatttgaaatagagcataatggtttattaggtccagatgcaagtgatgattaggctatctaacgtggtaaccatcacaatggcataatatccacagtagaataggagcatgatcaaacatatagaattggagatccaaacaataacttgaaagattttcaaaaataattatttttactaaattattatgattaataattatttattttcataaaaaaatgcactaatagcttttgtaaaaattatcgctaatatgacctaggattctaataaagcatgatatcgtatgattaaggatttcatagaatagtactcaatgatcatttgaagatactagaataatgagttactaaattataggatatactttgtgagaaataaagaagctaactagttttatcctacttatcaagaagtttagtaacattatatggattttacatctccatgttagaccatattgctaatatgtgattaaagtggagtaggtcatgggtgattatgaacttgtattgttatattcccaataatgtatgtagtatatattatctatttttatagagtgatcgtaatgtgattttgattgatgttttttctaacaatttggataaaaaaaaatttggatttgattagagaaaagtttgggcttgagaattctggatgcattagatttgggtatctcaagtaaagcaagattgtgccacagagtcaaccctatgagctgcttggattgggaatgcaaagaacaactccaaaatcagtatcataaaagatataattctttctgtcatatttatttacgtataaaaatcatgagtaaagattcatgaattctgatgcaaatattatgatcccctgattttactactatggtttagagctatcctcgatattgtctttgcaaaaaataactagccttttatcttcttacaaagtcaagaatgcagcctttcctaagggctgggcttattaacatcgagggcgacttagttatagcggtcagatagattctgaacaatagatgcacatcttcttccgcaggatatttgaaaaatgatgagaaagtattatatatatatatattttttgatactaagtatgtttattagaagatgaatagttatctattatgataatttattttttaattgtattggatgtatttaagctaaattaatatgattgttgtattaaaaaaaatatcaaacctttccatcaccatcaatccattgtattatactggcaaaattcccttgtagccataggctagccattggcttcgggattctaaacaaaactatttatgcaaggcttaccgtccgaggaatcatccaacaacaatcccattcctcgtccctctttttctaatgcagcctgcttttatgaaacatatatcttgaatcatggctacttccactgaaaccaccaatttgattcacagttaccgcagtaccccatgtgacataccatagagtccaatccaacggtgaaagagctagcgctcacgaaataaaaacatgtccttacgctactccgccggcgcatcaaaccgcgagcaccatgcccgtggagtgtgggcggtgacggctctgataccctggaaagggactcttcctccgcaaacgagctagagagagcgagcgagcgagagagagagggaggaagcgcgatggcggaggagagctcggactcgtcgcaacgggggtttctggggaagcactacgaggagctgaaggagcactggaggaagaacttcgccttcttggactactacaagaagacgctgggccgcgcggagacgctacccaagtggaccgacgccgatgtggaggagttcattgcctctgatcccgtctacggcccccaggtatcgtcatcgatcgtttctcgatccgaccctgtctcttggattcttgattagggctctttgtggtcttggatttcgaatcggttatggcttgctttgcttccatggtctatgttgatgatcgctttgttcatcttggattaggttttgtattggatggatcttgatgggtcttgtcttgattcagttgttataaattttggggctttcagtcgatctggagtttctgcttgttttagagatttgatgctgctcgctgtggagcaagcggtgactttttgcccctcaattttcaaaggatcatttggttaagtcggatagttgttcattttctttggtcttggcgttttatttgggatttatctgagctttgctggagattttgatattctttttgataagtgtattgtttcacttgcctgcttgtattatcaacagttggatcttttgtttggaatggtcttatctatattgcattttttgcttctgcttgaagatcgaaactttaatgtggatagtcattgttctatattgccgtaaggaggctaatgctatcctgttctcttgtttgaaataaatgatctgtatataaaatttcaatgtgctgaattgctatttctttaggttatttgatggcaaccgagaaaatagttcctcggaagttcatactttgtttagtagagatgcgttgcttctttttgtgcaagtaggttttcccaaaatcgtattaaagatgatagcctgtggaaatgatagctagtacaaatcaatttcttcttgtaagtttttgaatttaagtcaaagaaatgaaatcatggtgatctttatgagtaattattcgtttcttctcctcttcttttcagcttcatgattgtaaatagtggttgcttttattagttttttccttctctcttgttatttctcaagctctggtttatcattgaaaaggtataacgaagttgcttgaaattcaaatgcttaagctttggttttatgctagtttcatatcattctcttattgattctacgtgacatatatagtatgtgattgcatcagtttggtattgacactttctactataatatatttgaaggtagaactaacttagtcattctagagcaatgtatccccttcacaaataaaatatgcttattgttatcagcaaagacgatacattaacttgctgaagtggaagaaattcataaagtcccagtttatttgactatgttcactaaaagaaatttatgcacaaacttgttttgtggattctctttttgctgttacaaatgtgttgtttacggtgcttgttgatttgaaagcctttttggacatgttgcttcttattattgctcattcttgaccagttattgtaatttgtggtaaaaagaaaaccattctttcctcataatcagggcctaaaaatttgattttgttttggtttttctagatttgtggagttttacttttggtggttttggaagttttgctcgtagtttttaagttgtggtcaaaaaacaaaaataaaaaaatagaagaacgttaacagaagccaagaaaatttgtcacatgccattttggagttcttttggtaactaggttctctgttcatgtagttttggcgatattaggttgaaagttaatattgcatataagtgaaacaagaaaccatacttgtaatctgtattttggattttgaacatgcccatgttcaattgttatgtatttaactttagttattcagaaattcatatatctagcaattgtaaagctttgtagtgtctggggtatccaatttttttttcttcatttcatagtaggacttaaggatataatgaatttgggcatttctttctcactttttgagcttaagttgctaatcaattaaatgcatgaggttatagaatatcataattatattgcaagaaaaatattattcctataaatgttttctacttaactgtttgcatttgtttttctaaagtattcagaggcctgacctgccaaggtctgtagttattatctttccctcttttaactcaagtaatggagagaaaagtcattgaaaaatgatgttctatggtctatgtacctaaaatgataaagaaattatcccattatgattgtggacaccaaagtgaagctcaaagaaaagcatctttatttgtcatggtcttgttttggttggaacaactgagtcaataatgcaaaacaactagatgaagtacacaagtcaggttatgattcacttaattgaactttaggaactccatcttagtcatataaggagtactgtctaatacacagacatacacactaaatttcaatatttaagcattgcatgttgtgcatttaattgtcgatacatgaaatgacacatataccattcctttctagcagaatagtcacattaaaatgagatagaaaaagatgcaatgttgtaaatgggcacatgaagatacaaaataaatgcttgattcttgtttgttcggcatattgctttcactggcttcatggtgccaaagttgtccattttaaccatgttctttcagtcattttgattttaattcattatttgaatgtttctcttctgccatttcgttgaatatatattttatatttgcaatctccctgattagttattgctaacactgtaaacatgaagtagaaagttcttaacatgcataggcacacaaataaggttgtttggttgtaagcatattttagatatctgaaaaatgggaacaaaagtaaaggtagaatatggtaaaaataacaaaaatgtgcagagtaagaataatataactagttgaaatattaggcccccatttaaatgatgccattttgtttgctttagcactgaatttctgactgcattttgatgtgaaatgtaaaattcatgatacactattaatattgacagtaaaggaaccaaacaagtgaaaatgatttcctaaatgaaactttgaacttgtttcatgtttcctgatctagtttttgttcattagagattgcattgatatcacatattccaatttttttgtcctaacttgtcatgttctggtttagagattacctttattttttactctcctctaaatttcaccttacccgttgataaaagaaaagcagaagaaaaaggaaaaggaaggagagtatatgacatcttttatccaaagaatcaaaaaactgtaatctaggaacagatagtgcagcaattaaattaccacaacatatggtaatttaccacaagaaataggactatgacaggtaatttaattgtgcactgtatatgactgataagttgtgctgggcaaaaaattaaagtcttggattaatatgcaatgtagaacatcttctgatgccttctattacaataccaaatctaagtgccatgcacactcatatttcatcagtgttggcgttttgagataataatgcaaaatgactgatcttataaactgcaaattttggtctttgacatccttactagtgcttgacacttttcttttaattaccaattctttgttttcttacttgcttttgcaagtacatggtgataactttaaaagttatctaggatgttaaaggcatatggtctcggtcatgcaattttgtatttccatgttgaagcagatcccactcttctttatccttttttcatcgagcttgctaaattctgcagtttcccttatacttctttgttgattatttgctttagttgttgtatattatcttgctgatatttgggtgaaagactagattcctaatggtgttctggaatggacctcttttccctttacagttgaaagctctaagggaatcaaggaagtatgcaattgttggggcactccttggtgcagcacatttaggaggagtttcctggaaatattcaaagagcccacatggtactgtagctttattactgtcatacttcttctatgattattttgtcattctgaataatcaactagttaaagcttctagttaaatgtatggaggctaggtcccatcataataactgttctagtttatattttgttgatctttgggcaaagcctggcctgagtgcagcacataaacaggtttagcaatcatatactatattttgtacaagttatgtgatgcctaaaacacaacgcaatatgacatataagctacataagcatggaccaggatcaaagtctctttgcaacttttaacagaactcctctgttctgatcaatctgcagtaatgctgagcattagcatttgaagataaacctttttgtttaagcttgtaagaccgatgaacatcaaaagtttggtaaatagacggaagaatattaatctcttttgaaaagaaaagtatggaatatattttatttccatatatcaggttgatgtaaacattatcagttatggtaaccataaccaaacaattcttatcacatctacatcaattggctaaaagaagacatcactgattattcctattagagctactttctcaacatcaacttttgcaagtccttcctgatgactgctattcatggtcacaggtcttctgtgttttctggctcttaaatgaaatccgggtcatgtgttctaccaggcccttggattttgtcacacttgctcattgtacatcagtcagctcacaaccacattgttgattgctgaaacttctatgccacttttaatgtactaatttcgtgtggtggtgtttgctgtatcctattaaggtacaaaggctttgaaagaatgtttcttttacagtgttatggggaaaaatctgtgacagtagtgaagcacaagacaacaaacttgtatttctttcttttcctcttccccttttcctcttcttcatcttcttcttctaaatggtgatacacttttcaagcaagattcttgtctactgggaatagtgattaccttctattccataacagtcctgtaaattataaagtattcttttttaacaataaaagttagtgcatagttcctgtgtttactctttaatgattattgcaggttttgttttggctaccgggtttggagccctatgtggtggtgtctttggatccgaagtcgcagaacactggaagcagctctacaagatcgataagcagggtgcgaatctcaggtttctctactggtgggaggacaaaacagtaggtcagtggtcttagttggcttatgtatactgatttttttttctttgctcaagtctttttaccaataagcagtactccgttcatatgtggttgcttcaagatatgatctactcaaaatcaggagttttatatccttaacaccaaacctaatagcaaccctttatgagttggattcaaattcttgacatcatatgttagagggtcttgccataatttctcaaatgtcaattgcggaggtaggatgccgcctaattggtcttgcaacaagtttaaactcatgagaccagaagatagggctgtgaattgatctgagatgcttgagcttgtctcatttgcagctcgaattatgcttgaatcacgcttgatttaaatataattcaaccaagctcgtgtccagttcgcaggctcaaaactatttttaagctgagcccaaaagtaactggctctatgaggaccagctcataaagctggttaaattattgtattttactgagtgatcatgtatttcacaatgtatttaatactttttagatttatattttatgcttaaatgttaactatttctagatctaattgtttgaattaataaaactttaattcaatcttgaagcgatctgaacccactagttgaagtggtgacccttgacctagttcctttccaactcgatcaatggtcctgggtttagatcattacaatgctcattcacgagcaggagcatgggccacaggtgtttgtggagggaggaacagatcgatggttggggatgggggttgggggttgggaatgataagtgatgagagttagagagagtgcaagtgagccagattttgctggccatgttggtggaggccgagcattaggtagctgggagaactggagggacccaaggagttgagaaagagggagagtggagaagaatggtgcaggttatatgttgtcttctggctatgatggaggagaagagagttgaatattgtattgaatgagccgtagtccaaatttccctaatttgaaccattaagtaattggataaaaaacagataattcactcaaaactggagcaatttgaatgaattgctggctaaactggtggtccttactgtcttgagatattggaacatcaaatatgtgaatttagctttaaaaatgcttgtcacataagaaattatgtgccttaatgtaaaaaaagaaaaggtgtccaacactgcttaaacacacagctagagtgtatctgcttgagtcaaatgtgggatgcccaacaagtttaaagctgggccatgcctgcagagaaataaaagtgccttgaacctgcaaaaaggacaataaagtgtgctgtttctgcaaagttcctaggaacagatgtttgatctctctctatcagccttttttttttggttatgttcttctctactttgccatttctgtatgcttgctgtcatgggaagctttatattgatgcagttccatgtagtcagcaagcactatttatgaatctgctaagggtccctctagtttgcaaagcccaagttggtgggtgacacaattctggtacattttatccactttgataggggataggatcccgcccactttccgagtggcaacgggtcatgtatgagtcgggtgggccaaaacctgtacctgttctgccatgaaaaaatccatatccgtccccatcctatatccattttgggtcgaatcaggtcgagtaaaataaaggacctgagttagattgggtctggtcgagtatacccgtttccttcagaatggattgggtcgggtcgggttgggtatcttcccttgcatggggtcgggtctctatgctgtatatattcttctttccatagaaaatgttcttgataccaaaaaaataactgaaatagtgaagcttgcttttgtggatcttgatgaagttcaaaattaaggagagaggccatgcctattgtctaatttttcatgtacaacattttgtaaaaccaaggaaacaatataatacctagcattggagacatgtcttaggtctctaggtcatcaaccaataacaactgtttaagtctgacacctctttatagagagtgatctaccgcaagtgttgtcctgcagaatttggcaacagtgaaacctttcaaggaaaaattatatgttaaattatcaaaaaaaagttgtggattagagggtgacaagaacagaagctgaaaaattagtttagtaaaagaacagtaagaggatatagaataattgggaaaacagtggttacaacagcaatacatgctcacaacggcactacccacttaaacataaaggctactacctacatccaaacacctggaaacaaaccatctgcaaggaggataaatcaactgttgcagagcaaaagataaccaccctccttaccaaaaaaagatttcacaaattatggggatatgcagatcggggaaattgaaataacaaccaaccctaaccctagaaaatgtaaaccctaaccctagattgaggaaggaagaatcatcaggatgagcagctggccagcgtcgaatggacggaagagtgcagccaagggagggatggttagacagaggagcagaagcttgcatgggaagggatggagtagtgcagcgttggacaaaagcatggcaagggatagaagcatggtgtcggtcgaagggatgatcctcaattcttcaaggcattgctacattggatggatggggaggaatggagaggaaagcatctaaggcaaaggagaagaggcgtgggggctgggtgggttggggaagaaatgattgaagtcgaatggctgtgggggccaaggggcagccgatttaagatttttatgttatccggtcaggttcgagatggggcatactattatctgcacctgacgtgtacatctttcgagtttattttctaacatccatacttattttggattttaatcaggtcggataaaactgcagatcaggttgggtcgggtacccggtgggttgggaaaaatttccacttctaattccctatgtcataaggtgttttgttactctttaaggtgtgaaggatataatacaaggctttctgttctttaatttttgcaattgaccatgtgtgcccttcaggtgttatgaattttcccttttgcttttacctgattagttggtcctttccgattgtgctccatgagatgcttagcctgttcttgttaaagtaattggtcgtatgaatcctgggtttactgatgaccatccatgtattcttttagtccttttgtcgttgaacctttatgctcttctgacagggaaccgaagaaattgatacttgctcacggtgcttggttcgtgctttcggatccgatgaaagtgaagcgttgattgcacttgtaatgaagaaagagagagagagagagagagagagagagagagagagagagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcccgaagaaaataacatgctgtgatgacaaaatcctaagaaaccatatattttgacgtcttgaagttctgttcttcattatgccgagtaaaggtaggcttgtcgccgaaaaagctatcataatttttacccatttggttaaagttttatgctgcaagacgtgctattacctttttaagctgttggcatctatttgtttgccttgacgtggtgaacaaatatcatttggtacaatggagaaggatcttgatcattaaattgtgcagccaggtgacttttgcgcttaatctttgggaacagtccgatggatttgttctcctaacagcctctctctctctctctcatatatatgctcggtaggccacgggagtaccagcccatgctgggctttgcaaagggtggagaaatattcgagacattgttttaaagctttttgcacccgattcttctttcacccccctagtctgctgagcgctctttgatacaccgttaccacttgatgatttctgctataattacgaggggtgatgagaactaatcatttcgcacgctgtagcaggcctatgtatcattttgtagggtaattccgggagaccttaaggatctaggtggctttttgtcccttattttttaagagatcagaggggctaatcccacctttctaccttatattcaccccgctcacgggagtttgcagcggtgataacatttgagcaagtgcttgatagtgatttagcttcagtttcattggctgataatgctggtgggatagattccctcgctaggagagtggacaacaattcctttctttgatttgtgtggtttgctctttcaaaacttttatacaaagatttagtgcaggcatgtgtacggtccgacaagttcttggatcctgaagcagggtgaaggattgcaaatagtgactcctagttggttcttgaataaatccggtttgttggtctcagttttgtatcagagtttccattctagtcattcaattaggagttctccaattgatttaatccgatcctattttttgtcttcacgagaattagaaaacaatatataatatgcaagaactcaatgcttacagaaaaacaagtttaacaattcctcaacttcaaagcggtagattggataacagagacccatagaaagacatcaaacaatctcttaacatcaaagcagtagagtgggataacagagacccacagaaagacatcaaaccatcttttaacccacagaaagacatcaaaccctctcaagagtcgctaggacacgaccaaatacaataactctccagtcataataatattaatacgtattgaaatggtcgcttaagggatcattccgagactacatacaaattggaggtattcacacctaaacaattttttttttgttttcaaagtccctccaaccttatagtcctcagtaggattagcccatgtctaagctcgtaaaactggaatagtcattctgtatggttagtggatatggaatgtcttccatcgctggagctgcagtaaaatgctcattttgctgtactatcattggggatacaccaaaatgcccattttgttgtaccatcattggagctacatcaaaatgcccattttgctccactatctgcatcgtacaaaataaatatataagcaaaaagacaaacaaacaaacaaccaaatggataataagaaaaaaactccatccaaaaacaatcattttaagcaacaggcaatgatgatttcaagatatgtggtatattttcttcctttttttttaaaggaaaatgtggtatattttcttgcagaaattcctcagcaacaaatcaattattcgaagcaattgctttaattttcatgattatataatttgactgttactcttgatgaaagatatatgcaaaaatcaaagaaagcttctacttctaccccaaaataaggaaatcttttacagtttttagtgagtgattgtttggaaaaaatagaactgaagtagatgtcttactaccttatttttaagggactggatttcctggaacattacctgcatctgttcatgagaaatttaattagagacatgtcagtttaagctaagatatgtcagaaaaaaacctttgtgaatgagttcccaacctttgtggcacgtacgtgatacgtccaaatttcgagatgcctttccagggcatgcagctcctccagtgtcatattgtcagaggctcccatatctccagacatgtacctgtcacccaagttctttgaactcatgcacaaactttgtcattaagttaagatcgtttgggttactttttacatttgttgatttatttgcaggagagctgtgaaggtttttggtgttgaggcaggcaaaaacggaacacatatttaagcatgcaaccacaacaagttctgacaccggatctagctcttgatagagtttattggtaaagaaaggtccattcaaccatccactaaactaggagaaggcttagtagctactgacattatagtggatatatagttattttgcaccttgtgtaattacttgttgttacttcgttataaattctaactctctcccaattcatgattacatgctggaaggaagcaataaattatgagttgcattctttgtgacaaattggcctagagcccactagctgcaatctctagtagaaacctgctacatgccctaagtaatttcttacaactaatgctgtagaggatttgcactcttcaaatcctggggcttattccggaggcatttggcttaagtaattctcattaatggtgctcccactgtagttcattaaaaaaaaaaaaagagaaaatattgtttgtataaatagataattttattctataagaaacacttcttttgagatatgaagaaattgcataatgagctagatagattgtataccaagccaaatggattcatgggaggggcaccaatttttttttttggtaccgtacatgttaagttagtgataacaaagtcaccaacttgttataccataatctaccataatttgggctaagtagggatgtcatggaaagaaaaatgctttgtacccctaggtatggcttgtcctagagttttgcaaactgccaggcctaaaagcaataaggcccttcatgaatgatctacccatggtgcacaaaaacctagtttggtgttcattcagggtaagccaagggtgcatggagccgtactcttttgtgcaccatgagggaaccttccaattaaggaagttgctaaaatgactaaaaaatgaaaagaggagacctgatggtgtgttaccattctgtctcatttaagcctaaatcatccaaagctatttaggggtgcgcctaggttccggcggcctaatgcgctaaggattgtgttgtaagtagatattggaaaaagaaggcccattaactgtaacagtttcatgtttttttctctcttaagaatcggctagggtttcattctttatcctattatgttcatccttctcggttcctcttatatatgtgtttgtatataaatgcacatagactgcatgttctatcactagaattagatcatttggttatttaggtgaacccctcttaatagtaggataatcgtttgttgttgttataacaatttaagatctcactcaaaaggactagtgggaagatattattttaaatttcttgatcctatataaatatctaagatctttctagtaaaaaactaatatgaaattaaatacatgctcacacgacagtctttttagattcttatatagaatcaaagaacctaaattataccttttggctagtctttttggatgaggtcctaggttgttacaattatagtgaaaattttattattacactaaaggatttcttcatataatatctattgcaagattaaagccaacttctcttcttattaaccaactaatataattacatttcattttaggaggacaataagctaataaaacacatggtatataagtaatggatttttttttaatttttattttttaaaagagagggagatatttgagatgcaccatttgggactcaaaaagagaaactctagttcttatatggagaggtatagcaattggtgcaagctttagttttgggtatgcaatacatagttataaatctatgtatacatgtacaatatacaaggtcgagaaattagaaataaggttgatcttgactagatggctgaggatcgacatcgatgctccaagatatttgatgtgtttgagtatctttaaaatatttattattaaaaaattatatgatttggagatccctacttatgatccaatagtcaaaaaatatgcattatttatattatttaaattatccattttaaccattagatgtataagtgatgtataggttagggatctccagactgtatgattttttgatagtaaatagtttagagatagtagataatattcagcagcttggatcattggtgctgggcccttggtcatttgttcaagttgattttatttggattctatatattaggtgtgtgtgtgtatatatagatatatataaatacacacacatacatacatacctatatacatatatatatgtatgcatgcatgcatacatatacacacattcacatgcatacatggaaatgcataagggctcacctcaaacacttctgtagtatgttgatctcttgctttagaactgatatctcctgtttaaaagattcctgaatatacgtagaaaatcttcaactgtgagagaagataattgtgaactagaaggcatagcttatatattaatgctatcatccaattaatttatgtaattgtgcatggtagtatggcatgttctatgtgctcatatagttatgacggttaaaaattgtgtacttaccatgcaagatgggattgcaccacctaaacccataggcatgaagaatggaaatcatgtattacagaagcctgtcatgcactagaaatattataaataatttatgtaagcacagataagctaactaaaagagggtaagtctttgtttttttagaagaaaaatcttctcttggcttcaggatgatagattgtcatcgtcgtagagggtgactctataacagtggtgtgctagctccaggggtgtatgcacgaggggtgtgctgctcatcccatctttcaggatatcataatttcattcattgagtgcactgttttgatcatcaggcatatctttcagaagatgaacactataacgaactggatggcaacatttataatagagcactttgaggatactctatggatggactcgaggttggccctacaactcctctaggacattttgctttctgatttttttggatgtatttatataaaaattttatgaataattcattttttatcggaaaaaaaaaaggatagatctttgatgcaatggtttacgtactctattgtgacttagattttatggatttaaaatacagaaatagcctctttgcaataggggctggggttgcatatgtttgaccctcatttgatcccacagtaacgagggccttgtgcattggaatgcccctttcgcagacaagttaactgagctagttgagcaaactgataatgttgttagcaaacttagtttaaatatgaaatatttgaaatttcctccacaacaccaaattttgctttttttttttcttttgaatctagttaagtaataagcatattgcctggaacaatgattttcttttttcttttttgaagtaatatgctgggagtgcctccttctcaagttgaacttgggacttggacagggctgccaaccggctgaaataagtctggttggcaacccccgattaagtactcaattaccattgaaatatatatgcacgtgaacaaatattgcatgcataggcatgatcacatgcatgaatgcgcacagatgtgcatgtacatatttatgcatagacacaagcaggcatgaacaaacacaaacacattgtcccagacattaaacagttacaagcggtgcagagaaattatagctctggagtgcgtgcaattttgtttcttattcacaggaaagtttgcttatggtcttctgtttttgtgctggacttgcatagcatattcaaggatttgaggtgtttaagttggccattcgtagtacctagcaaacagtaattttcttaatgaacttgctaagttccataattttgcttcaaaaaaaaaaaaaatcaaaataactagaggcatacaatagtaaattattatgattacagtgccaggatcgatgatgcccatttattggcaataaccttatggctaatgatttagcaagaagcaaatcttaatattatattaccaactccaacaagaagcaattcttagggttctcatatggtcaatgattcagtgggctgcatgccaaactagaagcgacgaacggtgagatcactctcctttagaccagtctagtgtaaaaatcctatactaagaaacaaaaagaagttgacatcctaaaaggacaaacaacagaagctaaatggtaatgcatctcccaaaagtaatgtttttacaaatttggtttcttagcccagcaccaacagaattcccactttataatttgtctatttataactcaatttaatcaacaaagccataatccaactctaaacccgtttatatgggattttcctaccatgcttttctgaatagcccacttttatatggcgatagtgaggagccttctgaaagagctgcgttgaataatgaagtgcctatatgaccctttttgttgctacatttgcctagcctatgatctttgcaccaaaccctgattgcaatcagtatatattccattaaagaaaagaatccgtaaattgaatccatttgtcacttaagctaatacatgctcatctagccatctatagttctgattaatagtataattttgttatgcttaattttgtgaagtccaaaagagtatgaaaaagacctgtgcttggatcacttcacccccttcagtttgagcttctccacttgtcttcctgtacctttcaatcaagccttccatagtccttacataattcaaaaatagaagctcagatgtatacttaaggcttgaaacagaagcaaggtaagttattttttactgatcatactgcatcacatatgagatgataaatataggtcaagggttggggccaagaaataaataacatataccccctggtggctagctcatagagcttgccatgtgtggagaagatgatgataccaatatcggcatcggttaacactgatagctccttcgccttcttgagcagccctgcccggcgtttgcagaacgtgacctgccggtggacggggttctcaatcctcctcatctgcaccttgccgcgtgccatctccgcagacaacctcccactagttttgactagcttcgaggttgttgcagtactgttctgagctctagctgtctctattgcactatagtgatgactctggggaggggctagatttcacataggagaacattcgagctagagcaatcagttaggccatctttatgcatcactggaatcacttgaacagtgatctctttgatctactttaatatatatgtaccttctggagcctgttgattagactaaggatccctcatggtactcatgcctatctggttctttggaggcatagcaaacttatggtcattcttaattatctaatgcattagtgggtcttttgcagatcctcaatgggcccttgcaagtcttcatgatacatataattcttggttaatgagttgcccatatggtgccataccagctttattctttgtataggcttgtatcttaatgcatgtcattcttttctttttttttttcttgagtgtaattgtgttctttttggtgagaaagctagatgactttgactaaataaactatatctttggagtcacatctcttcctctcgttcctctttctcatgctttgggtgcaagaatcctgtcaaatcaaaagggaggctctcattgatgggaatcctcctccacccaccagtgacagtctatagatccgacttcatcactagggtttttgggaggcccactttgtgtccttgggcaagaggagacattcccttgtgggatgcctcatggatgcttgtggtttaggatataaagcttgattagattccaattacttttcttaataaaatgggatggtaagggtatatcaaagcgcattggactttgataataaaagaaccttaagtgccctcatgcatggcctagttgaagatgattggccactcttgattttgttggttcccatcctttattatgtgccctcaagaaatgaaagctagtcagaatttgcaaataaactgaagctgagacatggaagatcatgtgtaataacatttatgtggcaggcacagttggtagaaaccaccagaaagcctgaaaattgcttcggtcttattcatcagatagtgtgtcttcttacttctgatcatatcctatcgctttgagctgataaagattaatttagggcattcatgcaatatttatagctagccactttgctatttagttagttacatgaacatggagcaatgtatgtccttctgaaatgattaagtaatttcttgctccaatttccgaaggaatcaggtcatcagtgaacattctttggacctcatataaggattccattttagccacatatgcacatactcattttgcgtgaactctcgtgtgtttttcatataaattaaatacataccacaaacctccaatgagtaactagaattgaattaagggactcggttcaaggaatgctcatttgagccaatgaaacttgggtctgctactttgcacctctcctcaattcatctcctgctatgtattgaatttacatattcaccaggaaacttcaatcacaaattaacttgatgaattcatttgaaagaaatcatcatttaagccagcgagacttgggtctgctaatttgtaagtctcttctggatgatctcctgagaagagattctggataggaacacaacaagtagcattcatattgtatttctcaacaacaacaaaaaaaaaagagagagagatagaaaaaggagtattttgcttgaagtcacattgaagtttcccacttgattcagtttgctaaattttttatttataggagtagatgcattcgactgattgctaaccattggcctacatattactggtgatcctgtaggacgtttgctacgatcaatcactgagtgatcctaaacctaatcatcctatccaagaaagctcattgtctgatagaggtgtatgaactataggatcttgcctttattcggcaaattttgaagaatggatcttgccttcttcttgaaggaaaaaggaaccaaaaaactgaaagtttatgtagtacaaggtacactggtgcaaccctagctggtagtagaatagatgcaagcttatcttcttcattgtaccttacaagattttaattcttttaaggaacctacaggcagcttcatttcgatagatgtatacattgacaaggaatcaaacctggggcacaaaatgcaaggatcctcatccaattcagatataatttcagaaaaactcgccaaactggatcgatcaagcccacaagcaaaaagcatcattatataattcttgcgcaagtgggaaaatgcaaaaagctccctcctaaagtgagctctgattggtctaaataatgtctatatccaaaggcgcatgacttggaattcctttagtgcgtactcctccaaccaagttgttcattgttggaaggaatgcgtcattgtgttccaagaacctgttcacagttaggtgtcgggttgagaggagatctaccttgtaagaggagacaagtgttgtgagatagggagaaagacatggggatcgttccctgggcacaaccaaatacccaagcagtgcaagagattctaggcgcatgcacgcttaaaaagggtcctccatctcctttagttggcatgtgttcatggggattccaaagtcctcagtatctattgggagctttgcaaaccttccaacatgcaagggtatttcttaaggcttcatggtacagatcgaacagttgagaccacatggtccaaaagctgaaagtatatggaaccttgtggataggatatatagcgtatgaactccaccgccaatgattcttggatgaccaacttaatttcaaatggttcatgcaattttaaagcacgcaactagagcgattatttttattgatgatgggagtactgctaccatatgggttcaaacttggaaactctctcggcacaaggactgcatgtaagagctaaagaagaggtgccactacttgatcctagttcccttagctagcaagtgacctttttcacttggtatttaagattcatgtatctctttgagcaattggggtaaaatcaaatttgtgctcaactttgattcaaatgtgaacttttctttgcttctaatgtgtaagcaattgttcactggagcttgtcccaataattacagctctttgcttaaaaatttaaggttctagatatgatttttgtatggctaaaaatttggatctggataattaatgagggagggtctctcatcctttttctctcttaaagaaaggataagaattctaaatatatcaattattatgataaagtgattttttacataggaattgtagggtttgaaatgtcatggtgacattgtttatgtcctacctgcaccatgataaattttattatcttaatgaattaagtggcagcctaaaagccgcctctctttttctcccaagaaaaagagagatagtggtagtgcaccatggcttcatttaactaggttgataaattttcttgataagaacacctttatttgattgtgattacttaacacctttcatctctttcttaagataagaaagaatattttgtatactttaatcacataactacttaattaatttgaattattatactaatagtatattttgtgactttgttgtcccacttttgcctaggtctctattgtcacccagtgaattgtttgagactctaaaatctaagcatttgtaatgaaggaatatagaatcaaagtatcctttaaagtttgcacatgtcattcatgactacatcaagtaatttttatttcttcaaaatgcaaatctatgaatggagaattataggtgtgccagatcgatcaagttgatagatagatacagttaatccaagaaataaatttggtgcctttagagaaaggacttgaatttagaatgaaaatttggtaaagaaagaaagcatcaagaggaaggaataactcaaagataaaataaccaacgaataacattgattataaataagaataattgaatataagtaattctttagggagatttaggtaaactgatcaaagtttaggatacataagtttctcatcaatattgttgattttctccaagatggaatgaaacatcacattagagaactattgattaggttaaagatgtaggatctgttgacattcattgtggtgcatagaagaggcataaaaactttttctatgttgggtggttaaatatccatgcatgcatagagagtataagagagtgaataaagccttctgtttttatgatacaatttgatagttaattcaagctgtaactattttttttagatggtttctcatcttgataactctctttctgattgttgatggtggttacacacatgaataacttcttagtatcctaatagctcctcttaaatagttaattctaatatttgaccacccaaatatgacgttttatatacgtgccaagtggccagccagatgctttctatatattgagataaaaataattattaattaaatattgattggtataataatattattcatttattatagttggttgatggtaacttaattcatagggataaacattacctccattgctcaataaaaataaatacttttgttgaaccagataaacataaggtatcatatactcaccaattataagaaatgttaagtcaaccagagaaataagttatcatatatgattgatccaaagatatttaagtttgccataaaatatagcccaggaaccatgtctagtaacatgcatgatcataggcatcattttatgtggattgatcatgcctatcaaccataacaagtctctactcacagtccccttattattgttgtcgagcatatatagtgatagattaatttttatatttctaccatgtttgaccatggtattggtcaatttaaagctttttaaactcaatggttaaaaatatataaacaccggccattctaaccacatattcattgtttttagtgcacgtgtctctaatatcaaatccaaaaaaaaaaaaaaaaagtagaaacataaattgatgcaagcgaccaattataataattattattggtcaaaataaatttcaatctataatttgtttgctcaactaattattttaggttgattagtcattttttataccttgaccttttgactaatttgaactgtatttgttatacatatttttcttagtcaattaacttttataaccaattggatcattgcgtcgcaaatatttgagtactttcagttgatcagccttttcaagccaactttattaattcactgctaattgcgaaatagatcacttaggctctttaagccaattcacataatttcctgagttatttttgcgatgatatgtagcaaatattttacaatttgtaatggcatttgataaatgtgattgcatgatgtcgtggggccatcaaggagagcatattaatatgatcacatatatcaaccattccatggcttccaactaattgctgttcctttagctaatgtgcagtcttgttgagaatttttggacactccttggccttgagaacctgccaaggcttcttcatgaggataaggagtttttttccccactatttctttcgacataaacttacctgctaaggatgattgtcatgctcaataaaattgtgattttgatattgtcatgtgatcattcccttcagaaagcttcagtttatttcattgccttggagcttttctttgacattttatcctataggtcccaccagatgtgccagaaacatttcagacacaaaatctaaagatcaaagatgtcgtagctagcatgccagatagatggtgtggataatcatgccaaataagtttggtgccttagtaaatagtaaaagaatttcaaagctcactagtgatagcaattgaataacaacaagaatacaaacccaagaatgcagaataaaaagataaaatatttcaagaacatctgacttaattagataaacaacctacatatgaacactaggtcaggaccaatatatgattcagcggattgggcccctctaagccctgctattactcccttttgttgatgttgttttttctctccatctattggtgcatggccaaaggtgatcattaaaagcacaccgctgtgaaggggtcgtcctttggtgccgaggagaacattaaagacccgcttcgatggctgcagctctgagagctggggtgaaaatagtataaaaaatatccatccgggtttaattttgcattcgaatcaatatagatatcgataaaaatttaaaaatctaattagtatcggtatttatatttatatccatcgaaaaaaaaatagatatggatatgcatagacaactatctgatccgtattcgaatatttgaatctacctacaactttatataattttataaaatatttattaatttttttaaaaaatatacaaccatatagacatgatattaacttgatttatcatctattcgataatacgtttgattctgtagtcaaaaatatatttttgtataatgaagtttaggggtattaacaatcgagtgatttaagtttcatatttgtcaatttgatcaataatatggcaagatcgatcaaaataaaaaaaacagatagacggatctcaatgccgtttgcccatgatcatcatgtgaccacacctggcccactaaacaatcatacatagcttctgattttgatcatacatcacctctgatccgacccttgtcgacactatcttcctctcctactacgccactctcgatgctctccccttcctctaccacttgcccctcttcaacttgagtgccctccacagctcggataggtcaagcctagagaagaaggatattagattgaaggtgtggagggcttggtctggctcctccaacttccaaaactttctatcctctgcctctgccacctctgcggtctttgccgcatggcacttcaccactgtcatttgctcctcctcgagagccccttcttgaaccaaggatcgcaaaggatcccatcgatggtgatccttgtttcgggattcaggtctaggatccagccaatgagatgtcggagcttcggcgaggtcctcttggggcatcggtactccctccaatagatcttgcagttcatcgccatcaaattgaggtcattgaatagtagatacccaacattaaggacgtaaagaataatgctgtaggaccagatgtcgatcttggtgccgttgtagctcttcttagcaagcatctcgggcatgacgtatgctagagtctcgcagagggtgtggaggaggccatcgccggggatctattcggggaatgtggagaggccaaagtcagagactttgaggtggttggcattatcgaggaggaggttctttggcttgaggtcccagtggtagatgccgcgtgcatggcagtatttgatggcggagattcgttggcagaagtagcattgagagaggtcctcaagagatggcctcgagcaatgcatgcatagagcttgctattgcaggcgagcttgaggacgaagtagatcttggagcgggaagcgaggaccttaaggaagtgaaggatgtgggggtgatggaagtggcgcattatggcgatcttgcggatgacattgtgggcatagccgcccttggctatgcggcccttggggatggccttgagagcgatgctttgattagagtagaggttgtgagcgagggctaggtcggaggttacgtatgatcaagatcagcggccgcatataattgtttaatgagccacgtgcagtcacgtgatagttatggacaaatggtgttgaactccatcttcctattttctagattttgattgatctcgccacattattagccaaattggcaaacatgaaatttggatcacttgattgctaatatctctgaacttcattatacaaaagtacttttttttcctaaaatttaattatctaacttacactacaacaaaacaagatattagcataaaaaaaaattcatcgctaataactaattttcatcgttaatatttatcataaataatcgcgacattgataattttttacgatgaaaaaaaattttcatcgcaaataattgatattaccgatgaaaaatttttatcgttaaaaaagttattttattgcaaaactatttacgataaaaaattttaatcataaaaaagataatttatgatgaaattaattatttacgatgaattttattcatcgctattaatttaattaaattttttataaaaatcaaatttaaaaaagcattagtggctaaaatttttcatcgcaaatatcataatttctgacataaatttttatcactaataaatattaaattaataacgataaaaatattttcatcactattaatttaaataaattttttataaaaataaaatttaaaaaaattagtgacataaatttttcatcgcaaatatggttatttacgatgaaaatatttttatcgctattaatttaattaaaaatttttatgaaaatcaaatttagaaaaatattagtgatataaattttttatcataaatatcattatttatgatgaaaatatttttatcgctattaatttaattaaaaaaaattataaaaatcaaatttaaaaaatattagtgatgtaaattttacatctcaaatatctcaatttttgacataaatttttatcgataataaatttttaattatttatgataaaaatatttttatcattattaatttaatataaaattttaatatttataaatttattaaaaaattatttacaaccaatttttttatcgctaatatattttttaacgaccaatatttcatcgaaaataattctatcgctaataatatataaatattttttaaaaataatttataaatatatatatttaatttatatttataataccttttataaattaaaaattaaaaataaaaaaattatataataaatttataaataaattttattattttattatattaaattaaaattacaagagacctaaaataaaaataaaaagctacacaaataggtcgtcaagtgccagcatctgcggaaggagaacgggttggggaagaagaacgttcggatgagctcagaccgatctattgttgcctcatcagctgcatcatctgctctatctgcgtaatccattccatcatctgaatttagagctgctggtactcatcgacacgtgcagtcaatttatcagcttgctgcttagcctgcctatgcatctccaccagccgagcttcgcaggtagcatagatgtcagtcctgaatgagtgtgaggatgaggtagcagtgatcccatgccctaaactcctaacataacaggatctcataccaagcacctgatcacaactctcgccatctgtgggtgcgatcgagccctctggattggctgggatctgatgtctatcatacggtcttgaaaattaaatttatagctattttaatttcgtactaaaaatcaaactgtgaatgaaaaaaataattaaaaaaacttataaagagctcctagcactccgtcattcactcttttgatcgtcgctggtggatccactggtagatatcgatcataccagaaagctcgccactctcagtatctctctgtaatttgagaataattaattaaaaaaattttaattagctagagaattatatactaattaaaaattacttaccatctgctccatgtgacgagtgaacgatctcgaaccccacaatgcggtatggtctgtctcgtccgattcatgacattctggacacatcttctctatacagttagcaatcaaattagtaggtaacaaattgaatttaaaaataaatgattcaattattaaattaaaaaaaaattggatgtataatctgatatgccggatccttgtaatatcggtatatgatagtccaatcatccatagtgatgctgtcatagggccgctgtcgcattgcctccacctcatgatcctgcatcacatggtaccaatgctgatagatgtggtggcgatactccttgaaatacaaagataaatgagcatctacagctcgctgcatgcgatcctcctaaaaatcaataatatcaaatacaccctatcaataacaaatattagaaaaatactatactaattaaatattcacagtatatttattttacctataattgagtgtaaaaaaattttctctgagccaatacaatgtgacaccaattgaaaagcgtcacggggcataactgcagcatatgatgcccagcttgatctgccacagctcgtaccatctcctaatgagcttggtgtagccggatggtatctcgatacggagacactatctcgggtactcgcatctccaatactctaaagcgaggttctttgatggacctcaccctcacctcactaccggtggagactggcctgaaacaataataaataaatcattagtatgatagctatctaaataaaaaaaaataaattttattatataaaaagtataataatatcactgggatccgccttattgggacctgccagtgtaggatcctttgacgacggagctgatgcggcagtggaaatcgatgaagacgcctcagcctccgagatagactgcgaacgcaaacgtcgtcatctttctcctggtgccatacctacaattcttgacatataaatgaatataatattaaataataataataaaaaataaattatattctaatgaatagaattaaatcgcataccattattgcaagaaaagattgaacaaagaatatagatctactcatcaatattcgtatcttccttgatgtgtagatcctcctttgaatcataataatcgatatatgtgtcgtcttctatctcatcgtcatttatgaactgatcatcgtcctctgactcatcaagattaaatacaaaatcagcttcaactttgttagacggtagattagccctatttaaaggagtcattacaagttcttcatcaacaagaagctcggctaatatttgttcttcttgctgaaaagcttcctcttcatgtaaatttgaattttcatccatctctaatcgggttggtatgtcatatacacctctagatattattttttgtacgatatgtcaattacttcgatactttagatccttcaaatatattactaaatattattttcttaaatattttttttctaaacgagctccggactcggcttcccatagcccccgctcccacggcgccggcgtcgtcacacaccccgcgccgctcagactcgacctctgcgacccccgttcccgcgtcgccaccaccgtcacccacccctcgcgagccaccccccgtggcaccgctgccctctccaaccccccgcgatccggatcccaatttagattctgatcgaacttcgatctggatcccaatccgaattgggatcttgatccggatcctgacctcgatccaattcagatcgtgatccaaattttatttttattaatcaaataataaaatatttgattaatattttatttttttatttttttttctatttttctccctcgtttctctcttcccttcctccctccctaccatcacccacccctccgcgatcgcctccgtccctgccgtcacccacccctccctgacggacctgctccctgccgtcacccacccttccttggcagaccccctccccggccgacccactccgcggtcctgtggcaccgctgtgtcatggccgacccccttcccgaccgcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaattatataaatagttaatttatgattttttctccaaaaaaattatgtacataaaaaatataattttgatgaaaaatttaatttacatcgctaataattgttataagaacagctcttcaacttccgcaatggaataagcaccataggagatcgatagttttgaggtcttcgatctccaagaagctcatcttcttcttggagtccctgttctggaagtcggagtacttgaatgtcgcgatgattctgagatcgcgagagaaatctaccgagactgagtcataaattatcgaatacttacgatgaaaatattgataaaataagaattatcttttgtattgcgtctatctcataaagctatatctcagcaaattaaccttcgccgacaccgtccctacacaaatagcaagtcaaatacttccatcgcatgacagaagtgttgggtggatgtctggccaggatactacctctcaagatcttttcgatatcgcacgatgcagcaaaaagaaagaaaataaaatagaaaataatcaaaatacatggatcagccaaaaaagagctcgcctccacggggcatacaaacttcactataaaaaaaatttacaagaggagatctcaccctcaaccctcgtatacccaatttctccctcatagaaagttcttcctcacaaaagctctctctctagaaagacctctctgaatccccgaagtaactgctgtccactgtccaggagctctactccttctctttgcagcgtcttcgtgtctctctctcttcacggatgttcaggctccttcacagctgctcaaagttatccgcgcaccacatcaaaagtcaggccacaccataacccttctgttcacggtcacagccttttaaaggcttaaaatctatattagaatatgattaggagtcctaagatcaaccaaaaaccttctcagatcgttggatctcgatcgaaagctccctagaccgtcggatcgcgcacaaagacctctgaaccacgcatggaccgcgacttcagtccacgtgatcccatagaccaccagcaccgcatggtccatggtggaccgtgcgagcactgggctggcccacccacatacattgggccggcccatgtgcttacccgagttaggcctgcccgcgcctgggccgcatgcgcgcttgggcccgaccgtgcctgggtcggcgcacctgtgctgggcccatttgtgcactgggccatgtgcggctgcgtgctaggcgcgtctctgtcgggccaaggcacgctccgctagtcaccaccgtctcgtgcatcgtgccaccacttcgatcgctcgtatctcctccgttcgaactccgtttgggatgatcttgatctcgttggactccattttttgtcgcgaacctcactgtaagctcaatatggatcgaatctcgaagcatcaaatcctaacaagaagaacacaatttcaaaatatatattgatattgtaaaaatctgtagaatattattctctcgggcttctgtttcactgatttatagaaagaaagtaataatttcttgcaaaacaagaagaaaggggagagcatttaaactcaaattcaaagacaggatctaagccttaagagtaaacttaccttatcatgccaccatatgaataacttttttgtggatcatattttaacatataaagatcttgtatcatctcttttctatatttttggacagatataaggtctttgtactttgtgatctctggtcagtccatagaacaataacctacacaaaattgagcaacgagacagatttagaaaaacttgaagatgattaatataaaaaagcatgcctcataaactataaaatagactgtttacaaataaaaataaaaataatacatatttataataaatttttttcatcgtaaaaatagtttatttataataaaaaaatttcatcgcaaataataatcaatttttgatttttttaactattggcaacgaaataagtttcattgcgaataattttgtatttatgatgaaaataatattttcgtcataaaaaaagtcatttacgataaaaaattttcatcgcaaataatctgtaatttttatttttttaatttaatttttttagctatttatgatgaaaatattttcattgtaaataactctatttactatgaaaatagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaactattctgtaatttttaaattttttaaattttttatttttttcaaaatattgatgatcaaaatatttttaatgtaaataatctattatttatgatgaaaatcgattttcattacaaataatcaactatttacgatgaaatattttcatcgcaaataatctatagtttttgaaatattttaaatttctcattttttttctagatattgacgatgaaatattttcgttgggaattaggttattgccgacgaaaaaatatttttcatcataaataattaaattatttacgacgaaaatattttcatcgtgagtattttaaaatttaaaattaaaataaataatatattatttacgataaaatatttatcataaataatttgtatttatgatgaatttttttcatcatggtgaactatttgcgacgaaaatatatttttatcataaatattttattatttatgataaatttaatttttcatcataaatacaattattgatgatgaaaattatttacgttgcgaataattccgccacaaatttttttttttttatagtattatatcaataattatattcatacttccagaattcaaattatatccgtatttaattaaattaaatatagatataattttttacatctaaataatatctatatttatattatattcatcagataaaataaatatgaatatgaatatattggtatccaatcgatatcaatatcgagggccatcgagctgcatgaaagatgcagattttctcctacgaatgtacgtacgtaactgttatatccacacttcttgaaaaaaaaaaaccagcatctttttttttttttaaagggtgaaagtataatgttcgtcaggaatgttatctgcccattcacatatttgtagcttttccactctgcggcgttagtttgcgctaaccttttcggttgaagaacaaggatatgattttaatgtgcatgtcagcaaaaacttgcaatctaagacttaatgcgaagctgcggctttcagggtcttcatcgatcttctgtgccatgccctatcttggaagggtttatgaagaaagtaaagctattacgcatagcaagtaaaaacattatttgcttatcttttctcatgctacagcacaagtaaaccaatgcaacatacatgcttcaaggggctgcctcaactagaccaccatcagggaaaacattcagcagaaaacaatagcaactcaacattaaagctgctgaacttagtacttaatttggcatttagaataattatatagaaacttgtaatcaaatatgaaaaccatccacctttatgaaacgacatttcctgtattaacttaaaaaggaactaccaaaaaaatttacaatctagagagcagaagatgaggcaaactgaacgagattgaccatttgtttgccgcaccatgcttttctgagttctaatatatctgtttatgtccaaggaagtttctagcatttcggatctccttcacgtttgcccagagagcagggacctgaggaagcttttacctaaattttgctcaatgtatatatgatctttcctttcagcaagcacatttttgtccacatctgcagcttcgtcggacactgcatgttcatgaaattgggaaaaaaaagaagaaatggagttctcaaaagatcccttggaccaaatctgtgaaggtaaaaaggaagtgataaagaaaaagaagataaatgacagtggcaaattaaatgctaaagcgccatgctaattccagttcatataaacacttctttcaccaccttcacctcaagagctaaagaaaagatgggcatgcttagaggactggtagttgataatcttcaataagatccagtgacacaagtctttgtaggcataaatgtaagtgacaaaaaagaaaaaaatgaatgggctgagtattaaaataaacaccttgccacaaattggagttcataacaaagtaaaaatgtcaaggaaaaactagttgaattttattagacgatataacaacacagttcgtcaacattgttcaatagaaacaacaggcaatagggtataaatacaagcacattagcagctagatacagacaatattctgtgataccctaaaaatccttttggattaataaaacatgactatcaaatcaatgtgcaatttaaagcaagatgactgtgtcacatcccagacattgacaaataattaattggccccggcccaaattatgcggatgtgatcctcattcagggaatgtgtccacgttcataggaatgagcagctgtggtgcataaacagaaaatatctttacggggaagtaaaaaatacatcattcttttgaataaggtatttgtcctcatattgctagtttgtgatattattcaaggcctttcttggtcatttcttgtctctgggcctgaatcctctccttcaagatcttactcttttcaaaattagccttccgtttcaaagctttctgaaacaaatcaagagatacaaaagaggcattacataaagagacgcattggggaaaaaaaaaaaggtagctcagtgcacaaggcttcagccacggtaaggtctgaagagactccagccctacccctgcatatggagagactgtttccatatttcaaactgtcacaatgggcaactttagcattgcagctaggcttgccctctaaaagaggtatgctataaataaagaaatttagcaaatttgagatgattactgtagtagcagatggaaaaggaaggaaacccacttcctcacggaaacagcggtccagctttatcttcagctcagtacattgcccaaagaattttgcaataggatggtctatatggcacttttgaaactgttcaatgatctaaaataacaaaaagcaaattagcaaacccagagttacaaatttctagatgaagggatagaaagaacacattagcgatggaggaaatggcaagagaatatataaaacaccatcaactgatctcatgagtttaaaaacagggacctaaaaaatagatagtcattgctaatttcaaacaaaaactttatcctttttttttatatatatattgatggggaaaagtcatttggttaattctaaaaatcatgagtacttggcttgcaaataattattttgtactaatattaacttgttttacattattttacctgatagcaagcatttaatgaccacagacaagcataaaatgcacaggcatcaggaaccaaaagaaatggaaaaaaaaatgaaaaggatggcactaatataacacaatatgaagccaataaggagatgaactacctctgcacacatcggatgcctatgcaaagtcagaggagggtgcatttcctgcaaaattccaacattctaaattaagaatgatgcgaaaaaactatagaaactgaacccaatcatattataattagttgcatttttgcagatgaatgcggttaagtaacttgaaagtacaagaaacgcattagatgcagccatttatattaaggctggtaaaatttaattttggataaaaaaaatgatgggacaaggctaacagaaagactttgatattatcacaattgccacattactttcctgcaccaatttccaagcttaagggccacatgaatgtgaagtttccctacactatccatcctcaattgctatgttagagaagcacttcaatggtcaatgtaaatatatatgtcttcacatctaatgtcattattctgtagaatatgcaagaccttaagtgagacacattctctgaaacctggactagaagttttgcactataattgctactaaaccttgaaactaggccaagcacggtccaaacaattggccagcctatgaatcaaagaagcttctgagggttgcacaaaattcagcccagttatgcaagaccagatcaaaacataatccttctagtttaatttaacaggaacccttatgtcatcgattggaaccaactgagaaaacagccaaaatatgaagattaccttatttgatccatttactgacaaaacaacgtatcagctctaaatccagtctgctcaattaagatggatcatatcatgccaattcctaatctgtatccagtcatgctcaccatacaaatacattcatttgttcccatacaacatgatttactagcaccacatcaaacatatcttataaattgaaaaaaatattttcaggcataccaacagacataagtcctaatttcagttgacaaatgatattcatgataatatcaacataacaatatttatacaagcagaaacagtttagggatccttcccctgttgctattatgctgacaatggcgtaaggccatacaatagcagactcatggtccaaataagggatgaaatgatcaaaatggaaggaaaaattgtcgcttattcaaaaatgaaacagggaaaggataatacaactccatgtaaatcgatggaagtccattctatcactccatctgacaaatataatttccaaaaatgatccaccagagccattcactagcctaaattttgcttgagaaatgtgtcagggatctcaccaccagggttcacatgaagaccttccccagattgaaagtgatgccaaccagctcaactaagactggttggccttcattaggctacattttcttctttaaaatttctaatagatagttacacaattgtgaaaaaacactgaaaagaaaagttattgaccagttcttgatctaagtatataaggtgtttgtttagtccagcaatatatgaaaccttctggcaaaaacaaactatctaccaccgatagcatatacaaaaaataggttgtgaaggaaattcatcactagcaaaattggtcaatatgaaatgtcatgagaaagagtgcaagtcttcagaatttagaattagttactttcttaaatactgccttgatgattgaggtatcttgttaggagtcactctatgcacggttcaaatatcttaattaagtttaatatgaaaaaaatagctattcaattttatcaaattcaatacaatatagtgctgtttgatgtcaattcatgacttatattattaaagaaatacaagggtccattcaaactcccctttttcctggtcaacatcaacattcattttcaataaatatttaagaagtagggtacaacttcgacatatgcacattgttattcattttcacattttattattgggtaatgatacaagtatccatacaagaatattgaaattattatccacatttggtaaaaatggacatggatgagaattggcaagaggaatagcaatgtccagtgcaaacagatacaaacaaagagtatataagaggaacacccaaatgcagtgctaccaactatgcattgtcaaagggtctagtacttggattatcgaggagcctatccctattgtatctttcttgtgggctctaacttcttaagttgtcgacacaagggtccaaaggtttaggttcaaaaggagatggcaaaatatgaaagaagcaattctagaaatttaatagtgatcaggtcttgatcaagttaggtgcattgtatgcgtataaaggcattcatctttatattcataacctacaaagcataattgcatctgtacttaatgcaagaccgatatgcaatccacatgtatgggatgtggacctaatgtgctagaatatgctacatattaactcaaaacaaccacatgtcatctaccatcaaaataaaggacagatgtgtgaatttgcacatttaagcatacatagaagttttctggatttgtcttatagttcatagatatggatacaagggagacaaacctggaagattaagttatagggagatgtttggctgttggtccaaagttggaagttaggtactatgatgcataaattaaaatctgtgcataaagagactcttagagtttgtcacaagtttcgtatcacttttatctcccaggattatgcataggtgaaacaaagaaaaattagtatatatgtccagcagagaaagaagaacaacatataggaagatgagagaaaaaagaagaagagaaaaagaaggacaaggaaaagcaaaccaagtttctcctgaaacataatgcttcaactgaccagtgttggcatgtacatgattcttggtatgggaagggtggaaggcaagaatgaaaatatgtgatttttttcatatagaactatggcggttacttatttaaatgtgctgcaacattgttgataatcacccaaaggcaattggtacttcagtatggtttacatctctctcaagctttgcactttaaaagcatcgcgcattagaatgtaccaaaaaaaacatcatactgattccaatgttaacatccaagtaccatgtaggaaacaagaaattcatgctaatgggactatagaagcatattctgccataaagaaaactatagttataaatcaacttggtttatttatcaggttctacttcactgttcattcttcctgctttgatcaaaatatccccaatctcctcttatgagttgaagcatgttgaaggaatatcaatgccactttgttgtatattccctagtcttcactacaaacagacaagtcaatgcaattgtttccacattacttcaacagcactactcctaagctctcttaatcagaaatttccacacattcacttcatcattctaatttctgaaattagtcatcctatctcatttatctattcattgcaagctgctgtatccacatttatctgtcagattaaatcaaacaacggttatcttctagcctgaccagcaggcaattgccatatgacatttcaaaaagacatctccacttctaccacctaaatccagttcaacatgaaacttcaaagatttttactcagtagcaagtaaagaaaacctcaagacctatatatccctactaaagtcatattttgcccgtgagcattaagtctcatgacctgtcatctaaagcatatgggcaccaattggaatactattgtaaattggagaatcatatcacggcagtagacgatggctaccaatctgacagtctataaagctaaagagcaagcattaacgaactgaaagactatgaaaacaaatcaaaatacgattgcaaccatatacatgtgaaaaggaagttttaaaaaaagcattaagccgtaacatcaccaacacgaagtgccagtataaaaatagggagaattttttttttttatatagaaatccagggatggatctaatcatcatacctatgatcttgaatttggatgagaagatcgaacaagaatacagggctttcagaggcagcaattatagtgtcatcttgggctccatgccagcatggaggccgaaatggggatgctgatgacctgtatcatgccgcccagtgacccaagccaaacctcagtctcaaccagacaaggaaacctgggaatctgggatattgatggaggattgtgggcatagataagagagagaggtggcccgaagcccaacaattcagaaggaaagccgaaagttggactaccaagccatcaaaaggaaggccatagcctagaaatcgagaactgcaacccataacagacgactaatgaacctattgaacgacaagccttagaaacctagattttcaattataaatggaggaggtaggaggttttgggctcagatctaggtgctattgttttgcaattcttttgatcttattaatttaatttaatgattatattattatattcatattcaaagccaaaatgtttaatggccacaccatccaaagatatctgcattccatccaaattccacattagacaaacaaggcggcaatactaaaacatttataccacaccatgctcatttgttctgtctgattgcaagaccaaccaacttgagaaacctgtcatgtatagaaatacaaagcccaacaccctcaagatgtttggcagcaccctgtttgcagtccaaactcaatgacagaccaaaaaaaaacagtccatgtaaacagcatgaagcacaaaacctagcaaaaatagcacatcaagcatttcctggttacagtcaaggatattgctgaatagaatgcccaacaatcaaaatttaacattaattctccatgttttctttgaagcagataaacggtgctattctaaaccttctaagaacactcggagggaagggaggtaacattaatctaatgcaagttagatatttaaccttataagaacaatcaaactttaacagttattcgtcatgttttccagctatttccgttaatctaatgcaaggtagatatactgcaataggattcacggcaatggaaggataaaatcaagagattacggtatgacttactcggatgaaatgaaaccctagaaacgtcaatggatgggaactctggcaaaaactcagcagaggagaagccgaggatggtcacaagctgggggaaaggaggacggcgagtggtaaccggctttgatcggaaaatcaacgagaggagcgtccgccagctttgattgtagaacggcgaccggcgacggcacgattcagggagaaggctctcgcacgtgatcgaagacaaagagtagggagaggcggcggaggcagagcagaagaagaaaccctggtccgagaaaggagcgggatctggggaggggagattgggtcgtcggtttcaccgtgtcaggctttgcgattcgagcgggatcccagcccgaaaaagcctcaacccggtccaagcttttcgggcccagcctgaagcccgaccgggcccggcatgatgggccttgagccggccacgagcccattgtcatcacttgaaaaaaaatttccgttcactttctcctctttaggaaacccaaggcatcgtggccgaggagagaaggcgaaacaatagagagatgagcgaagacgtacacggaagagcctaccgacaattcgtcctcctcgccgtgatatctcttcaattcatcttaggtttgcgtttcttctccgacccggaatcaacagttcgcaagagagttctaaaatttcaaatcttctcgatttccatcgtcctagatctcaaagacaccagcttcattttctggcgtcaaagtcccctttttttttcgattttttccgcgattcatgtatcggatattcctgttttacctgaattccggatcgctggatttgtacgcgtgtgaaaatttcagaatcctttgattgttgcattaatttcttgaagatacgtcgatttcgttgctatggtttgttgttcagaatttgtttcaaatttcttcactcgttttctgtgtatgtgatctatttgattatcaaaattcggtctgatttgccctgccctactttatataatgttaggggtaaacggaatttggtgacattgcgtcagtagaatcacttactttcatatcgtgggacgaaattcagtttgatttataactgagaaccaaatgccagtgtgtgatgtttgttctgcggtttgtagagatgtttattactggaaatattacaacttgtttcctcttttctgtttattatgagtgttttgttgttcaatcatttgtttaggctgtgtctcgtggcttggtgaatgttgttggactctcttggattccatgtatatgtggtgtatattccctgcagactccatatctgaaactccaggggatgaaaacttgagtagggtgacatatagaaattgcttcctagtgaaagtatggttatcaaaaaaaaaaagagaaagaaccaatacgagagaagaattgtttaaatggagatataggatgcaacaagaagtgtgaagggcgatttgatcaccaggattaaattttgatgatcaacaggacaaattgaagcaagctggattgaagaacccttattttgtgaaggaagttctcttaaagaaatgttgttaatatgtcaaaaagttgccctatataatgttcaaaatgatattcaaaatatgacttaataataatgaaacatgctagaattattttactgcaaacatagaaatcactggctctcgtagagcttggcataagccagctggtcataatacctagttgctgcaccctatgctacatccctcggtactatatttctcttttttttctatacagaaaatgttcttgtcagtcttggcctaaagcaatggttgttggcaattgttttaaccacagtgatagctgttgtctccttcttatgtgtcctacttggtgtaaaatcaggccttaatgcttctgttgggaaggaatcctcacgagtgtggaatacggatcccctatctaagatcgctaattcaggtgatggtgtcaataccgcaataagaagaaaaaaagataaaaataggacacaatcaaatacgtggatcagcgcaaagccaacctccatgggacatataagcttcactataaaagaaaataaatacaggaggagattacacactctcaactctcataaacctctctttcaacaagaagcacttctctttacaatgctctcacaaagaatccctaaggagatcctttgcagcttcctttgctccatgggccgttctcagccgctacatctctctctcagcccatgtacccctttttgtggggcccaaactcactccagatcgaaatcaaaattttattaggactcaaaaaacacctctgatcgttcaatcacgaccgcaagctcttctgaccttcagattgcgcaaaacaatgcatgaaccgcgcatagaccgccctttgcatgaattggttatgaaatagaccctatccatgcatgctgcatgttgcgcacttgtccacgcacgtgtgagccatgataaactcgctatagaccgcggcggtccacgcgcgatgcgtggactgcgacttcctgtggatgcgtggtggaccgtgctgtgcaccatgtgggcgcgctagtctgggctgagcatgtccacgcacgtgtgcgcacctgcacaactgggccacgtgctggacgggtcgcatgcgttgtagcgagcttgggcggcttgcgggcctacgagccacgcttgtaggcttgccgcctgtgtctacatgcctatggggctggacttctctttcttgggctgttgtgggtcaaattcgaggcatcaaaattcaacaatctccacctcgactcgacattcggccttcacctaactttaagaacttctagatcatcttgcccccatgtcttggggcaaatgtttggctgctcatggatgggcaaacatgggagtcgagccagaccgctcgataccatctttgttatatgctgtgatctgtttgacctgagatctgatcggggtagcctcctgcagtaatagaaacttcattctgcgatgtatcctgtcatcctttcgagtctttcgtctcatgcccaatccatctgtatctggagctccacctcgttctgagctcccattggctcctaaagctctacctcatgctgagctctctgtcaagaggtaatgttctccatacctcttccctttcatcacaatcctactgtcgtgcaagactttaggattttttcctcagctctccatctgtaactgttcgaatccagtctactcagtgaaagtagattatttctgaagctggatatatatcggatcttatccaactttctcactgctccatcaaatatctgtaagttgacaatctcaatgcccttgatcgcacaacttgatccatccgataaatgaacagtgctttcactactttttagagagtcaaacagctcatctctacaacaaacatgatgagaacatgcagagtctaaaattcactatggaaaaaaagtagatacctcatcaatcaccaaaagaacattatcactatcttctgtatcgctatcttggactgccatcgcagtagcactcatccgatctctgagctatgggcaatctctgactcgatgccccaactcatcatacctgtaacacctgatcttgctgtagtccctcgatttggatttggaccgcccatcttgagatcttctattgcttcgttttttgccaccacctccttcagtcactgccattgccgagtcatcatctgaactcgaagctcagttcttccatctgagaacctcattctggagaagtgtagaagtgacttctttcatcttgatggtgctcttccccattagaagagtagtcaccaaaaactcaaaaggaaaaaaaagtaatgaaggcaagaccaatgccttggtcttctcctcaaccttcttgccaatgctgagaagatcagtgaggattttttgaaagttgctgagatgctcctgcatgctttgtccctcactcatctgcagctgatagaactgctttcaaagaaagagagcgttggtgagtgacttcaccatgtacatctcgagcttcatccacatcgctatcgaagaagtgtcgctaagcatatggatcaccacatcatccgtcaagtacaagtggatcgtactcactgcttacatctggagccatctccaatgcttcttctccatggtagtcggcttctcttcgcacaagagagtatcaatcaacctttgttggatgagcacatccttcaccctcgcttaccatagggagaaattgcttttcccatcatactgattgatctccatcttgattgagcctgtcttctctatcttcttcaacatcgatcaataccactacaacttaggcaaccacgtatgctctgataccacttgttggaaaagatcccttacgagtgtagaatacatatcccccgtccaagatcgttaattcaggtgatgatgtcgataccgcaacaggaagaaaaaaaggatgaaaataggatacaatcaaataaatagatcagcctaaggcctacctccatggggcatgcaagcttcaatatgaaaaaaaataaatacaagaggagatcacacactttcaactctcataaacttttttccttcaacaaaaagcactcccctttataatgctctcacaaagaacccctaagtagaccctctacagctccctctgcttcacgggttgctctcagccgctacacctctttctcagcccatgtatccctttttataaggcccaaactcactccagatcgaaatcaaaattttatcaggactcaaaaaaatgtctgaccatccgatcatgaccgcaagctctcctgacccttagatcgtgcaaaacaatgcatgaactacgcatagaccgccctatgtgtgaatcagctgcgaaatggaccatatccatgtgcaccgcatgtcgtgcactcgtccgtgcgcacgtgagccgcaataaaccctctgtagaccgccgcagtccatgcgcggcacatcttgggctgtgcgcgtccgtgcgcctatgcgcgtgggccgcacgctggataggtcgcccacgctgtgcaagcctgggtgcctgcaagccgggcctacgggctgcacctgtaggcctacttcctgcatttgcctgtggggttgcgcttctccttcttgggctactttgggtcgaattcgaggtgccaaaactcaacagcttcatcattacaacccttactacatgaaagaaaatacctaccattaatctaaaaccatcagtctggaaagaagaatttggaggtcaccttgaagaaaggacaatcagaggaattgtttgttgatgtagtctgttaatggtagctcaatcattagggaggtcgacacatagaaacaaagaattatcttacttaaataaaatgggagtaggcatgagagcagatttatgtatatgtgtgggtaggaagtttttaatatcatacaatgaaagtttttttaccttttagcaagtttaattgaaatctcccactttgtttcatttcacctactttgttagaattggaattttgggagtgtgactccaccttaaagttttttgtttagtggcattccaatggtttagcttggttagaaaatttttgaggatgggcctcttgctagctaatttataaagtgattgagggtgacctctactcaactcttaccagtcgggggtgttaccaaaagatagattgaaacaaaggatataagggctcttttcgtcaaatcttgactcatcaaataccatgttcatcagtggtgatattctgataattgcttgccttgcctggcttttttaccccattagttcaaagtgtgactttagtgtgaacagaattcaagagcatgtagaaataaggaagagccactggggcagcgaggaagcatgccaacatggaattctttctattttctttctctctcttgggtcccaatgaatcttcctttaatacctagataatgatgctttgttagagggtggtttacttgattcccgctactgcttgctttccccttgtctgctaacttagccattaaagaaaaaggaaaaaagctactagggcgggccatggtagagtttgaagttagaagttgctattgttaaatccgctcctcaatcttgatcttatggatgatttgatttgtgagtggagtggagattcccgaaaaagcctttgcaactttgctataaaacaatattgtcaaaatagcatctctgctattcccttcttcccctccttcccaccactctccccttaatggattgtctcgttctatgtcctactaaataggttggatggacttaaattccactttctgtttttctagaaaaatgcttttcctttccatggtgactttgcttggtgtcattttctgctctttatcatgctaattccttcaacagaaccaactcggggtgtttgagacctttgtgagtcgcatgcattgcatgtccctgtctaataatttgtgaaataaatggacatagacttactcaagagtaaagctcaaaaatcactagtcagtccaaatcacaccaaggtatccaacagagagtaaaataattaacatcattttatgcaacctccaaagtcacaacccaaaaggcatataaaaaatagtaagcaatttcatttttcctatactttagcaggggtattgttctgcagttgcaaagggttgtctactaattatctgttgaagatggaaaggccttcctggttgtcgattgcatatcatagatgcttggtataggatgtccaggatgatagaacactgaatgatggatttctaatgaactataattatacttgaaaaatgagtaataaaatatacttgtttgaaaatgggtttaagaattaggaagcaggtgaccaagcaggtacacaaccataggagaaaatttttggctaccaggcacaaatgcacatcacaaaatcttgattcattgtttttgatttctatagatttctccctttttctttcctcttcttgatctgagaattgcagcgatatcttatgcataaacaaagctcaattaggtgctggtcactgaattcatggctactaaagctttttccaattttctaaagattcaagagtcggagaatccggttaataatgagcttaacttttgttctttgaggcttgaatgcatcattattgattatgaaaagttgtctttgataaactgctacttgtagaaggaagccaagtggtttctgtacatcagaacatatgaagagatggtcttttgcatgctattctttcctaattctttggtcgttactttattttttggttatatagattaacagttttgaaagtttagtgaccatactatcactttagattctttagacttgttttgagttaaactcaattatgttgatggcataggatagttcctaccagaataaataaacaaataagtaaataaataaataaatcaataaaaaacacataggctagcttattcaaaaagatccaattgagttcatggaggtttaaagtgcacaaggcttaacaaaggccctactttcttgaggttcatatcctagatttcattagcagtaaatagctaggttgaacttttacagaatggctcgtggttggttgaatctctactagggcttcggaatgcaaggttaaaaaaattggccttaaagcagtttagatgaaaggacaacttagttctagtgtttgctgcaagtttctggaaaattatgggattttgttttgaaaaatgaagattgattaggcgaagtaaaatatgtaaatcataagaaagatgcaaaggattgaagttttaggtctgatcaaagggaaaggccttcatttcagatcaaaacaatgacatctcagagaataaaaaagggggtaaaggaaagataagaattataaaatattttgtgggtgcactccatacctaaaaattgctcttggacattcaagttgcatagtttgatcagtggctccacacacgaacataggtgggttttttttctccttcaaagagatagaacgcctgaagtttcactaaacttcttcataaaatctttctagaatgcccctctttttcctaaaggccaggacttcaaagaaatttgttgagcttttacgtgtaactattagctgtaaaggttgctaagaaatctgtcgagacatttgcttgccatccatgatcatcgagcaagattttacatctcaaatgaaatataagtagtatctgcaacttgtattccacagagaaccagatcaatattgaatggtacaaactgatatagggaaaaggtcttaacaaaattaaaattgttctggcttcccatgtttgttcagcaggccagaattggaacagcattggagattgtgttcaatattgactggttttggacttaggtatgtttgggcttctttctggaaaaacctgcctttgcttaggtttatttatcttattatgtatgtactgaaaatggatatgtgctgcaagtaaacctctatgagtaagttattggagactagagagtctgttgtaagccaaggtttaggctgcagatctaattttatttatttatgcttttggattggtggtttgttgacaattattaaactagtctagttgtaattttcctggctctgttaaattgttcttgattttaattcattctatgcaatgccttctgatagctttcatttcgttgcaggcctaggcgacggtccatcaacttccaacaatgcaacaacggctgatgcccgttccagctctagtagcaaagcaggaattgagatactttatatatgtcttggagttgccggttttgggatattgtctattttccttttcaagcattggcagaaaaagaagagggaagagcaacatgcacgcctcttaaggctgtttgaagaggacgatgagcttgagcttgaacttggtcttcaggattgagaacttgatcgtcaattgatggtaatgttatgggtgagaatgcacctctgaaatctagattcaattgcgagaatggttactagcattatcacaaggattataattgggcatgagtgtatattatgaattgcagttcttttgttcttcccaaagatgcaagttaaatttttttcttgcatatggcaaaaaaaaaaaaatttttccttgtggttgttttagaaaataaccccattatcagccatgatatgtactcactcatgaaaatgacttctccatgctaggcattagcagcatttttttaattttattttaaggttgatatcatacagtcaggatacatttttagcagtttaacacaattcagtttgaagtggaaggaagtgaacctgacagctaaatgagatacataattgatcttaaattgttgatttgggcctgctatgtagctgactgccgactcagttttggttagatgatataacaaagaagctggagcaataagaaagcaactcattgtaacacatttcaatttcttctaaaattctacctttatcaatcatctattctaactaaagcaactcactgtaacacatttcaatttcttccagaattctactttaattaatcatctattccaaatcgatgaagtccatttggtattatcccttcaaattgctgaatgattaggtgttatttctgcatctcattcatttctccctatctgaacatatctttcttccgaaagacctatgtggacatttccttcaccaatccattcattcaatgtcctttgtgcttcccgatacccaaggtcatcctcgttgtgaagttttattaggatagtacctggccttccactaactaggactcctttagagacaaattctcatgtggtggacaaggttaattgcaccttttgctgatcttttttccaatataaacaatcactactttctgtacctggttattttgctgacactgactcatgcacctttgttgcaaaagtccgtacacatgaaatttatcatgataatgtgcacattaatcttttggtctcacttggctctgtagatgtatattatttaggaaattgagcagatatcatggattctttttcccatgattcatatgaagaggggaacttccgtcttcaagaagttgcttgtataatctttctacaggacatattgcaattacttctgtgtttatcctttattttgacccttcatggcgatttctaataaaatttttgtttaaattacttgcaggtcttggtctccattcattaaaatgttctccattgctagtgattgttagaattttgttgtatccgaaagttttaagccacatgcagatgagatcagatgtatttcatttttctgtatttaatataatgatgttattgatcaggaattcttccagtaaatggggattccccttctattttcattcagtaaattgatctgaatttgtacaaatgcattagtaattctcacactgcaggttccaggtactacatgtttgatgtatatgaatattttgtatggacaactttgtttccatttattcatgatgtgaggacaagcttgcaagattaagccagttctgtttctccaagtttattttgtcatattgcactgtcaaactttaatatgaaaaatcccacagaatgaatgttagatgattaataactttgattatctctgaaagttctgtattctaatatttttgtttttactttttctataatgataccttcatggcgcagatcatttgaatagattgctcttctctaaagaggaaactgtgatgcggaactaagcatgatatatatggccctttctggcttaagccatctatgcttctgatggtggataaatgtttgggtaatgatgttttacatgctttttgacgcccatgcatccattatgattatctaagcatgttctatatggccttttctggcttaaccatctaggcttctgatggtgtttaaatgattgggtaatgatgttttacttgctttttgacgcccatgcatctgttatgattatctaagacataggatacaatagtatcatttttggtgagagggatagagtatattcttatttaaggttgttctcctgtatgaaaccaatgtttgaagccttcattttgatctgtggattcctattatttttcctaaaaaatgatgctgatagatggtttgattatcatgtagcttattttttaagtattatacttactgcagacactgtaaccttgggacctatcagaaatttgctcagatgaatgcttgcatatttttttgtagaatgccagtcaagttattcagaaacattgatagttcatttcctcatcattcattactctgaaggtaatcttgaggggctatcatggtgaagtggctttattgttgaaagtgcttatattcaatgtgtttcataattctgaagtaacttttacgtaaacaatatcagacaccagcattggcttactgttttcaggcagtgcgatcgttttccaaagagaaatgctgtcatcagaagaggatatttgttttactctgcttaattgtgtcctcataattctacttgatttctgggcctcctattattttctatcatatatcatcagcttcaaatggatattttgttttgctggaaagaacattggtgtatcgcaactattgaagttttgtggttctgtagttaaaggtaggagaccagatgtcgaggcttatggttcttttgcagtgctgtcaaggcttatgttcttttgcaatgctagtggggtctgctgtttggcgcttaaacatcagaagatagaccaaacctctggaatgaacatgtttgacataactgatgaagctagaggaagtgggattaaatagatgtacaggttgtaggttttaagttaaaagaacagatctgtgtgtgcatatctttgaagtaaatgaggccagttttggagttcaaaataggtccagaacgtgggccacattcaatggcatatatgagtaaacaccattgagtgcatgacacagcaatgtcatgcacacatggaaaatgatgagatgaagatgttttatcagggaccagagtaaataacataggtactagtagtgacagaatatgatagttttttctgtcctattccagtttagttttgaaccttggtacagaagtttgtcctaagttggcctttgaatagattttttcccctgaacttcccactcaaacaggttaagctggtggagtgggctgtatttcctattaccatgaggtgaatgtttcataggttctctgatcaagtggtagccatgtaatcaagtgagtcatggttcattagtgttagtcttaatacagcaggatagtatcttctgtttattctttttccctgcttctattatttccttacatagggatcaatcatcgatgttttagctgatatcagccattttatttgttgtcgaggatcccaacacagcaaatgttttatgttgattcacttggtttcagatctggtttatggagcagtatgctgagaatcatatcatgagtgttcttcatatgcaccacccttgcagcactgatttgggtaaagttgttgcagtattgattcagtaagaaaagctatcataatgttctcacaaccatacggaactgtaaagcaaaggatatgagttgcatgtgattctcttggacctacaccatgatttaccttaactaggattcttatttggaaacaacaacatgatgtagtgcactaccttcatgtctaagctgtactgttcattgtcacactacctaagtttgctgtgaattcttaccaaaagaactgttgaagacactacatgggctcctgccttgtacactttggctttctgaaagttccttctgtacagcctttcaccaatgaaatctgtttatttttggttccatccaccaattattgttagagatttgaaaattgaagatgcaaatcatactctttcatggtggtttctcaatgtcctgtggtcatgaaaagtttggttcatattctgacctttatattgccaatcttttagttattagacatactttaggcccttaactaatgctttaatatcatgaatacagaacatacatttgatgagttactttaaatgtagcatgagttatagatgtgtagtctatagttgatggtccagattgatgttcacagttcagtcatcagttggagactggagggtctgggattttagattgcaagtcttacgcaagctagttttaaacaaacatcttccccattggtcagctttactgggcaatgtttttcccagggtatctttcatgtttttattggtaatgagagccaggctagatgttaatttcagttcagctaccaagttgaatgtcaaggtcttgatatgataaggtacatttctgtagctgaaggactgtcatgccatactagttaccatttttcactatgtgaaattgtctctcactctgccagcctttctatgattgctcagttttggatggagaagattgtatggaactaaaaacattatatgccaagttctacaatattactcatggggtcagcctgagtcactgatggtcctggtcaatcgtgtcattttcagtatggctgtaatcaggttccatgaactaattctctctcaatgcctttgccttttccttttgtttgtgctcaacttgctgattctcgtcgtgctttcagtcagagtatctaatgacatctagcgtggtacttcctgagttttgagctggtgatcgccatcatatgtattattcttccgaacaggtgggccaggaattatcacggatagggaaagaagggaactctgttaaaattttgatagtgaaaaggatttggtaggatttactctggcttcctatagttaatcttttgtaaactatattgcttgaatttttgatgtctcgcttgttataaatcatctaacatactttggatttcttctaccttccatcttggttggcataaaacaatctcaattcatctttatattattcattaaatcacaagcatacacaggtatggcctttaaaatcctagttgctatcaatatttgcttcaaacgaacttggttgctgcagcagaagagatctcttgcccctttttatatatagaatatcaatgaaaagtggaagtatatatatttcttaagtatgttaagaaaaaacttctagttgctaagcagaattggtttcattactgagacaagtctgtactcacgaaaaaatgatgtgatttaataaggtggttgatcgattttgtgaattgcactgtacaacacaaactttatggatcaacaccaccatcaacctctcaaaattatgctcatttgtagggccacatcctttgtctattcctttatttttggcttccttggtcccctgagagctggagatgctgcttacctcaacctggcaatgaaaacgaccctctcgctcacacgcacagatagctatcatgttggtaggtgggatgggtgtggggcagcttcaacttgcctgcaggcaacaaatgtcattgcttgccaacagccattgggagtatggtgatccacatcatgaactctgtatgaagggaagtgggttatggaaattgatttgtttttgttaatgtttttgccatggagattatggaaatgggttagggaagttatggtttttgatttgcttttgttaatgttaaaagtgaacaacaataactttactaaaaacttcccctttagactaaaatattatgtttgaactttaaataaatagtatattagtaccagtagttgcttttaacagaaatgttttagagatgataaatacttaggtgtatgagagacaaagaggccagaaccttttcactgcttgtctcttaaatttttgcatgtacctggcgtttcttcatcttgttgcctctagtatatgcctttttaatatcatttaatcactcggccatatacatatacctacatgtatgtatgtacgtatctatctatctatatatatgtatgtatgtatatatgtatatatgcatgcatgcgtgcatgtgtgtacatatataataggattggacgggaagaggaggggaaatcagaaaaaaatcacagaaaagccctcaatggaaaaacactctctttccattacaggcccaactcaagtatggcctaacaaaaactcttttttccagggattagttatgatttcctcatccctagtgtagcaaaacaaactagtagaaaccttgggcaacgcatgaaatagagccaagaaatataagaacgtgtttgctttattatcttctctagacaagcgcaagtcatgtcctatgcacatttcgacgcaaaaatatgagattttatcaacaatttgaattattttggtggacaaaaattagagaagagatgagactactcagagacagatatcacacatgttgtaaagcaactaaacataacttttccaatatttacaaaagcaggaagcagtaactagaacactgatatcatttttctagaaaaatgaagcgaatgatggtcttaatttttttctttttgatgcagtttatagatatgtatgtttccatgctttcaggatttattgatgagtgaagtttagatactacctgggtagcactatcatcaagctgccatgcattgcactcattttaaattgagatgactcaaatgagtgctatgtgtctccaaaattatagatttacaactattaattaatgtttttaaattttaacaaatacgtgccaacaatcaaagtaacacatgtccaatgggagtatttggacaggggttagcatcatctggctgcctgcatgtaagtcaatatgtatttaatttctaactatgaacaacttaatagactcaattgttatggttttcgtggcaaagctgcagacgacatgggcagacattatttttgctagactaaagagcagagagacgattgacggggattccatcatggtggtagcctgattacataaacaattatcatcagcagcagcgcatcttctcattcatgatagtcagtgtcagggagctgcttttctattgagattcgttatatttatcgagaggtcaatagctctactgactggatgatcttttatgtgactgagcatatcggagagacggtgtggactaagatcaaagatcttccttcgaccttcaagaatatttattttttaatttttttggatgtattcgtatgaataatctagcctatcaaaaaaaaataaagtgacatgtggcctggcacaaagtcacgtgaccttgaattccaacaagcattttagattataagcttacaccatgggcgagggaagttttccacattttcttgctacttctagacgcttggcatacacttacatgtctaaccaaatctcatagtaacagcaaattgcttgaaatacagattgctctatgtcaaattctttaggctgcagtgagaaaggagataggcgaaactgaagaaggggtggaaaatctaaagttccataccaccagttcatgcaaacatcactggttggtcagctgacctctaacaagaaagactattcacatggagggatgacccactgatgccccaaaacaataatgcaaacaaagagagggtcgctctctcacttgagcagcgtagggatgccagtgagtgcaataaagaagtggggacgaggtattagaatttcgatacatgtgtgcgtgtgtgagtatcacagagagagagagagagagagagagagagagagattgcatgaaagtcctcagagtatgggacatctccaaaaccaagtccaatatctagtgatgggctcttttatacaaagagtgatgcgcaagaaatagaagacatggaggtgagaagcttgatccatgcatgcatgaacatgatgtgagagagaccatgaagctgaagaaaggtccatagccacagaggcaataaaagaacatggttgggatgttaaatcacagtaaatggtgaaaagaacatggtgcaactataaggggaactagttttagtagttcatctttttaggaccacaccgcaaggtggacagttggtgttacatttagtctctcttcattctcttttaagggaaaatgtcatctagagtttgcagaagttttgaagttttacaatatcgcttaatttaattcaattgatgaacaataatatttagtgattgaaggtgtgaactgtaaggtcacttgaaatttagagtctatacacattgggagttcaaaatatctggtcaattttattaaaatgtattgttccaatattaaaattttctcgagttttctttaaaggactctagtgttcctttgatctaaaaacagtctaattttttgctaccacaaatatactacagtagaggcaaaaaaatctagataacacaaaggaacaaacaactttatgtttttaagcaagcaaataagtacatattcttccaacgttttctccaagaacatgatcaatagttcaaaatgtttgtcccttgatattctttacagaaaaaactcacggacaataagcttaaatcttcatggccagtatattttgtaatatatggtgaaactggagttcagttgttctacaatcctaataagatcataggggtgcaattcttgtgtccttacacttagggaaaaagctttatgccccagctagaaagattatatcgatggtcccggaggagtcttgatttagtacataacttctaaatgtggagcatcgcccaggaaggaaatatatccatattaacaaagtttgcaacatttggattggatgatagtccaatgaagaaaaattgacctactcaaccatgacaatggagctgtcctcctaacatgataaggacatagcaaccatactttggtgacattttaaaatcatgcaattacttcatcatgtttaccatggaaaattacacaagaagatggaaaacatagcatagcatttaccataaagaaccatgcatcgttacgtcatccaagcgattcaggtgcatgcatgtagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctaacttaataacgaagtcttatgtatgctaagttttccctttagaatacttggaaggcttgacagcatgcaatcattcaatcaaaacaagagagataatagattgtttcagagctaggcttttggaacaagtaaatatagtaatacaaatagacaatacaaaagacaacatttttgtttccagaaaaccattatagaattttctaagcctttcccttctaatgaggaacatgttcattgcaatgttagagctatatgactaacttgtataacggacatgccacgttagccttgagtgatcttgaaattgttgaattagtccaacaaatacgactatttgctgacgcctagcccaaataaaacagaattaacatgcagtctagtctgaattagtggcttccactaaggattagaatgtttctcctaactatagagcaagaagacctcttgtatttagcaatgttatccaagctggtcgttattattcctctagaattggctcccactgatcagctaccaaagttagtccacagcacatagtcccaaacatgtcattaggtttaccataaatttagtatttcttggtaaatagaggcaaacttgctgactgttcatgcaattaagttaccttgacatatgtgatgcattaattacatgcaaagaaaccatctatcatttggagcttatactggaaattgaatttcccgagagaatctatatattcatattcgttcatccctcgattgtattttcaagaaaagatttgaattttaggcaacatacctttttctctattggtcttaattttttacatttccaactacttaatgatatgattcagatacatagggtttctacccatttttcttgaaaagaaaagaaggaaaggaaaatccaatagaatttacagtgcattgttgaatctgcctaatctgaaccatgactttaaaaaaaaaaaaaagaagaagaagaagtttctggctacatttttatatcagcttataattagtttttattaatagtactcaccaggaaaagtgtaaatattaattgttcttatgtattattgcttttcttagtgtttttctgttaggaaaacaaaagaaacttgaaattgcactaactacaagtataaaaatgaaaaaaggtaaggccaatgttagagagcactaaggcttcatggtataaccttcaaaagttgtgatggatacaataccataggtatttgttcttgctagccataaaaatatacaagcatatgagggtagcacatggtaagtagacacaaggtatatttatcttcatgatatcactacaataacctgatgatatggtgatgatgttatccataaccttatcaataatttggttttgattttctacaaacagggatgtgtttttattctttttgaatatatatatatatatatatatatatatataagaaaaaaaaccttggcaccggtagggcatcatgttaattaacagacatgataatgtagtactaaaagctacatctaatataattgtacttttactaacttgatgtgaaacttaaaattgtattgcttgggatcaccactttatgttgcaccacttttgtgtgttcttgagcatatctgcgcatatcctctttcactcgcattatttagatattaagtgcaaacatttaagaaccagttatccttgaaagacatttgagactgcatgaatgccatcagatttcttggccaatggaatgaagcaggaatggatgtaatgtgatgtacgtgggtagaagggacagcgttaacatgaaacatgtggaagttttaatattttgagaagagatacatgcaagttacaaaaaaattaaaaaagaacatacaaaaaaaaactatttatagatgaaagaaatgaaaagaaagaaaaactttaaaagaaagaaaaaaactttaaaatacaccgcaacgattaatttcttattcaccatgtcacctcttctatgaataacgaatcaagaaaagatctgtggcaggtattgccaagccaagcttcaataaggttttgttacttctagaatccaaactcccttgacctcatagttatgcgagagtctagtctattcattacttaattcccccacctaaccctaatctgagaaggaattattatggcttggggagatcacgtgcggaggaggcgccaccgatcgttttcactttaccgcgcgcttttcagtcctagcagtgcccccccagtccccaccacttccctgtcaactgctccaccgcaacctctcaatctcctaacaatcactccaataacgacaaaatgatggagctaacccatgacattttatatcgaagatatagtagcacaaactccatccggcggtacagcttacccagccaacccaccctccactctttaagaggaaacccacatatccgatgccaattgcatgcagtggaaagagagagagagagagagcgctgagctcccttcttttccctcggaatttgcggtgttggacttcaccttctcttccggcgtggaagctgagttcccggagtggtagttttttcctttttttttttttttttttgagaacaatttctgtctttctttctttctttgttgtttcggctttttgatatttgtttcctttcttgaggaatagtttttatgataataccggaattgggggttgctagaaatcgtgaggtgtcattgttataggttttttttttttgctggatcttcggcgatctttttgctgatattatccgtttttaacgatcggaacgttggttgcgtcaccaacaaaatgcgactttgttctcgcttctcgctagatttgctccacgaaaacagtagctttgtcggatcggatcgtttgctccatgtctagtttttagggttatcttttcacatgttcttgaatatatctttgtcaagaaaaaaaaactttccttttgttctataacaaaaatcttttcttccacgtattttggttgccctagttttttcttttttttgtttgtttgtatttgttagagaatcgagatttgagccgtacatctcgttcataaactgtttcatttgtcagaatttaaagaaactaaacttcacgtatgcatcgttatccatttgtcatgatcttgtctcatgaatatatgtattctgttcttgtcttcgccttaatttttttctcactttcttttccgaaccctaacccattcaaagttcccaccttttctctcttacttgctttcattgttttttttccttttttttttttgttgcttttaattttgcttgaataccttttgatctatggaaattaataagtcaatatgtcagtatgtgaaggtctaggccatgttagtcccatcatttcatttatagtttagatgatgattttttctttgttcttggcaatattctagaccaacttcagcagacagaggtgaaagagagatcatgggtagaggaaagattgagatcaagaggatcgagaacaccacaagccggcaggtcactttctgcaaacgccgaaatggactgctgaagaatgcttatgagttgtctgtcctttgtgatgctgaggttgcccttattgtcttctccagccggggccgcctctatgagtacgccaataacaggtatgctttgatgacgccttctcttccttcgctcatatcaagttaattttatggcttcatttgttctatggccaagccaaattctttttaaagttctagaatgttaatgatggtagttttgctcctcttcaatttatttgcttcccttttatccctgatccaaatggtttttttcttatttaaaattaccctttcaaattatcacatttaattcagcttttattattattattattgctatgagattagtttgttgttaagattctatataggaaggaatgatcaagtgatcattactttatgtagtaagaaattaacaagcaaaagcagcgtgcttggtcttaccatgaggatagaggaagagttttaccttgactagggcaactaaaaagggtttgagttttgcctaacattcttgttatatgaattcgatctgtacacgacttactactctggtattagaacgtatgtactaagaagttttcttgggatggaaagaaagaaatagtgaagtaaatcttattaatttgtctttacatgttcttctcatattttctcatactcttttcttatgttcagacttacaccgaaaaattaagatggatgatattatgttcttggtataggatttcttttccgacgtaccaatgttttgttaaggaaactttgtagttgacttttcgattataatattttccaaaggactccacgaaatggtaacatctccagtcgtttcaataaacttccgatcatattatgggtttgcatttaaggttttcttcttcccttcgcttcctctttgcctttgcctttctcgtgttacacttctggctcgtcaatctgcagtactctctagccatctctctctctctccatccacacccccccccccccccaaacaacacacacaccctcccaccctgtgcaactaattccgacaaaataagggtctcccattgttagagcacctcctgtatggactgcattctaaagatacgggaaaatgagccagatatctattcatcaatcatttagtagagtctctaaggttcctttttaaaactgtcttgaaccggcttttgcacaaagagcaccactccctttatttataagttgaaccttcctgaaagctaacttgggtttcagctttcactgttcaagtaagtcataaagtttttctggtcattaaaccttgtgatatggagatggaaactgcttttctccctgccggatttctcttctggtgctaagcggctaaaacccatcatccatgtctgccttcctcttttatgggtagttgctggacttcggacaccggtgaaggatgaaggctctttgtgattggttatgagatatttcttgggccccgtgcctttgctgtcattccccacaactcggtggccatcatagcttttttgttagctttcgtccttacaaattcctctctggttctttctttcaccttttcatgcatttagcttcattgtcaacatcaagggaacacagaccggaagaagagcaagaagaacccaatcaagactggattttacaaatcaccaaaaaaaaaaaaaagactggattttactcgacgacgctgcagtcttctctgctctcactcaattaaaataggaacaaggaaaatgtagatattttttcccttttcgttatgataattataatctaagaaagattttaaaagcttactgtaatcatctcatgttcaactattgtgttgcacccaacgaaatttctgtgtgcctcatgacgagcattacctttccatggttctgacacgacattgcatactagattttactgtgtacgtaaaaaagcactgcatgacatcatctctattcttcttcttcatccctttttttttttttggtaatatctattcttctttaatgtcctctctgataactggtcttatgtacaggtacatctttacaagccttccgagagaatatgaatgcgtattttctgcaaccgagtatattctacaaataaaatgttagagattgtctcgaactggtatacaagcacattcctgtacgtgttgacatgaaagaagcatagatcagacaaaaataatagtacgtgacaaagatcataaagggactacaacattaggagggctacaattaataataacaacgggagcaactagcagtgtatacggttcagaccagatcagtttagagttatttttggaaccgagctgacttagttgtttttctaaagcctaaattgaaagagaaaccgattcaacctgatccgaaatactcgatttggtttcattcagtttatttgggttgatgttccatagtttgggctacattgattgcactaagtctaaatataaaaatttcattttatatagaattgatgttcaatggaccggactaagtttaaacatataaaaatatttaaattttgaaatatatatgtacatatacacatgtaggtcgggtaggtttaaatatagatacttacatataaatggattgggtctggttgggtcaatgcgagtctgcttaaatatatatatacatatgggctaggtcaaatcaggttagtttatatatatatatatatatgtgtatgtgtgtgtatcggatttgttggtttgcactgattttctaaaaaataaaatcgaaatcgaatcaaattttttctgttcaagagtatctcaaactaatttttaaaaaaaaaatagatataactagatcaaaaaagaccgatttgaataggcactttatgattttgtcacttttttgtatacctctacgagcaacaataatagaaacaataataacaattgtaataatcaatataaaaattattaatagtaattaaaaaatatatacaaaatttttgcaagcattcaagtggacacaaatcaaagggcactaatgcattcataaaaggttgctagctttgatccatggtagcatcgtgtatcctgaatcatttgtaggttaattgaaacctcctaaattgcattttaaataaaaatagcatgcattttatgaagataaccttactattattaggtaataaggttgttaaattctaacctaattaatatctcctaattaagagataatagttgtggtggaaacgagatggagagaaagcacttcatctctcatctttcctctctaaataacatttcactaagagatttaattattggatcaaggctagccagtttgttatctttttttgttctagaagtgttgaccttttaccatttctcatatgaaaaaaaacattatctaagaagaataaattattatgatcatgaggagagagaaggggtgttaaggttattggattaaaatcaaactgattagaggaccttgtttgctattataaacccatgacaacaatcaatatgcactaaagttttggtataataagttatcatcaagggccaaaaaggattaactcgagaacacaagcatacaatttaacatcgtacatagataaattcaatttaggaggtaattattgatgtatatgcttagacaagaagaaagtatagaaagtaaggaaaattgcttgaatgatttagaagtgcataaatataatctaaatttgaggagtcttatttatattttgagaattagaaagggggagaaaattgaacaaaactttgataaattgattgtaagaattttcaaaccttaaagcgaaagtgatagtgaagtggaaccattaaccataatttgatattaaaaggttatctatattcattaatatcatttttttaaattattgtatatattttttgggaggaaaattatgttctttaaaagttagattggtttcgtacttatcataaatgataaatgatctgaatttagtttgaaaattatttgacatataacctttgataagaaattacatattaggattttatggtttactgtcatatagttctttgttttgtatttatttaactttgaccataaatgatttgaagtcaagatactttaattctagcctccccatcaacatgttgatggcttatgatttttattttttataacatttatttttatctataatatttttcattattaatttaatgaaagtggattacacgacatctaacttatatttttgaaaatagagaatgatatggtatactattttgaacatgttcagaaattagaatcttattattgttttcataaatttaaaatattatacttgtcaatatgaaacatattaaaaatgatctaaaatattttttaaaatttaaatgtcataggtttgaaaaattcttacttgtaaatatatgatttgtaactaaatatttttaatggcatgatattattttctaattccatcaaagatctagaacctttcaaattagttgaacttagatacgtgttttaatatgtcttaatcaagatcaacaatttgacttcttattttatatgatatatggtatattctcacttgatgcatctgtaagaaaatttaaaattcttttattttattttatatatgtgtcaatactataattcttgattatatggatttctagtacacttagattgtgattgttgtttggcattggaagatcgagacaattaataccataagtgggatatatacttgcttaacccaacattaaaccaaaatcacctctcgacaatcacacaaggacaagtgtactcaagataaacatggattgtcaagatatatataagaataataaatcatgtatataattttttttcatctacaaacttctcttctttctcttaatttagtatataacttccataccaatagattactttttatttgacccaaaaatcaatttaaccttttgtttttaatttaatcctttgtcttcttaaatgactcagcttgtaatttaaatatatcattacttatgcagtaatgtccatttgttgtaaataaatatttggcaatagaagaaatactataaggtcaaaaaatataaacaggacaatgaagcatttcgtatagtctattataaatgtagaatgaaacataataggcttttcatttgatctataattaaatataattatcaaatatcaaaattaatgtaccaatttatgagacatcaatattataaagggatactaagaaactaacgagagtacactgatcaagaaatgtgatcgaccagtgaggcatgttgtttataaattaattagacacgttttcaatttatgagaatttgtattcaaatatttataattgataaatggatcactttttatttgctctttatatttagactccaaatagtgctgtaagagaaaaaaatttgaaaaaataatttatattttcaaaaaaaatatttttatcaattttcattaccataaaaaaagatcgaaaataaaattaagaaagaatgagataagtttgataattttagacatccgcttgcataatagttcatgtttaatattaatttatcactgagaatgcaaaaatatataaaatttttaattaagctttgctacatataattattatatatcacttacataaatgatttgattaaatatttttaaaattttaatctaatttttaattgcatagatatctattgcagtaattttcctctaaataataaattaaactaagaaaataaaaaatatttaataacaattggaatatacttatcaatcctataagaataattcctgtaaaactccatccatttaacttgcatcatgcatcatttatttttttatttttaatcatttagaaatttaaaatcaaaattcaacttttatagatttattagaatgcatggaatgatttcataaatgttgcattgtactaaaagaatttatgataatctatacaagtcaagcatttaaattacttattatactttacaatagtaaactaccttttgagcaaaatggtggtaacccatcataatatgtcatatgataaataaaatgaagtacaaggctagataaagaagggggacagaaagagagatatagggctcccgagcttaagcaaccaagcaattcaatatagttgcaaccaataaaatccgatatgagcaaatataaatataactcactaaaagcccaaaatacacccaataagcccaggtaaccactagcccaaacataatggcctactaagtttgaattttaaagtttaagtctttgcccattcaccacctctaccttccaagctctaattattttaatgccattgcaaatcatcatgtcttctcttcttctaatttggtgtactatcattttcaatgtattgcaactctattgccaatcgatgctcctccaaggcatctctcaagatctcatttggctctattgcgctaccactaccatccatcctattactctctagatcaatatcaaaattaatgcagctcttttctcgatactttttgcatcatcatctcactccatcatcacagtctatacttgttatttggagcctatgcttgctactatattgtgacctcaatattacaatctctacttgttaccactcaatgtccatgcccatcttccatgaaagctacttggcaaacaatcctaataggttccaaaaaaccccacagctaaggactaaacacacaaccacacaggttctcttatactctctttatttagattcaaatctacatactaggctaagagtccaattctagtcaaactgaatcataaacatcataatcaatccatggtcaactccaaccatttatgaagcataagatcttatctaaaaaaaatcaaccaaaagttattatttggcttccttatccctatataagtatctaaatatcctttgtgtacaaccaatatcaaataaaatacatgcttgtgcggagatcctcacaaaaatatttagcaaaataatcctatcaatgttgttaggattgatgttgagtcataaatcatatatatagtggattggattagattcatcatcgatcgaattatagatcattagatctttttgaattatttaagatttttaaaatatacaagaaatgcaaaaattaaaagtataagatgaatatagaattgatgaataaagaaccaaaaaatatactgaactaaaagagagagtatgttggcttaaccaattgtagcaaggtagaaaccccactatggtatgtataacataagaaagaccgttattaaaagagaaacagatgcaaatcactttattctaagattaaaaatactatcttagctagctactttaaggatacaacttttacacattcactcacaaatcctagagatttagcaaaagagaaaagagagaaaaaagaggaaaggcaagggaagaatagttcctataatagaattttcactagttaataactcaagtatctctaggatgactacaagagtagctccaataggatatttgtaggtaatatataggaactcaattcttaaacttttcaatgtgggattccaaatttcattctaactccaataattgtaatgcaaatttttctaacaacatcaaaagttattaacaataaactcataacaattaaaacttttcaaaatttattaatatcaaactctcctaacttagacaaaaaatggatagaaaaataagtaatcataaaaaaactagttgacccaagtttataggatttgagacctatgtagcctaaacctataacccatgtggttagaacccacgatctatgttgttaggacttgcaacccgctctagcatcacatacatttaagaaatctaatttgcttccttataagttcatatatatggaatgtctaataaacaaatattgtgcctgattattcaagatctatatttgtaccatctgccaattaattatcattttatttagaatgtggttaaaaaatataaaaatttctcttttaagtccataaactccaatactatattagttaccttactaaccaagatctagaaataatttaaaatctataaaatttaatgaattatagaaattggactacataatccataatatgacattaaattctaatttcttaatagataatgattcaaagataaggtccggattgtttatggccattttatctagattgtaagatgcataacttgaatgataagattttaacaacaatagctcctattaaaaattaaaaaaatatttcttatatagttatcataaaaggtggtaatcaagtcatattatatttatcaaagcactgtctaagcaatagctacatgatactctatagtatctaagcactattctcattatctttatttctctttttaaaatttagtgagatggttgcattgcctccatctatgacttaaatttttggataacaaagccatatctattaagtttctttaatgaacatattttggctcaagtccattaggataaaaatcttttagagagcatgaaaattatatggttagaaaatgttactaaaggtgatttcatatgattcttaatgtctaaaatagtgtttaactttcttttctctatttttagtaaccaatgtcaacaaccttaatgaagcacttgaaaagatcgtctccttaataatttatattgtaagtttaaattttagttccttgaactattgataactaattgttacttcagtaactcatcaaactatttttaataattctctccatgattctcttacatgtccttttaaaatgcaacatgatatatcaatatgcttttctattagacaattcaacttctaattatgagtaattaaatatataatttttattaaaatggatctaatttttttggtttggcaactcttttgttcagcataagatcaacaattgataggtacaagaaggcatgtgccaacagttcaaactcaggtgccaccatagagattaattctcaagtaagaaagacatggcaatttaatctaaaatagatttctctgaagtccatatatttttgcctcatatgcttatcagttaaaattcttcatgctcataaaggcataaaagcaagtcagtaaattatttgtacagttgatctttttgttgtttgttcatagccttacatgtatctttgaatattttgttgatatattgattgcacagattttttttcttatttccattgattgttgcttttcttggatatatttgataggtttgattgagaatagtggattaaggtggtttacaacctttctttgagagttgtaagggtgtaaagggctagatctactaagagatgagggtgatgatactactaactattaagactatgtcggagtcctttttcttatggataacatatatttgaagttgtcattccttataatgtaagaggtaatgaaaagatttttcttgcaaattagaatcactttgcatcaactccaatacttttctttatgctaataaggtagtgaattttagtgatatcgtctaggaatgattcaactaatacctcattgcttttgaaccataattgcttttcctctattttcttttttttcatttcaatcatatttgttatggtgtaggagggaaggtatcattaatcccatattagttgtgagtcaaggaggactctgaaggaactacccatcctacatgaggtgctttttggattgaaatccaaagggataaaattttgagacctatgagccaaaacggacaatacgtaatagccgagccatgagctcttggttgcaacagtggcacactaggaaaggaatcacccttatgactgtgggatccctctcatccgtacacaaactccttgactggagggcggtaataaaataaagatgatggtaccttccgtctatccatagacttcttcttgactgggggctatattgtggcgtaggaaggagggcatcattagtcccacattaattatgaattaaaaggctgggactctaacttatataggaaggaaacactcatcctacataaggtgtcttttggattgaaattcaaagagacaatcatgaggcccatgggcaaaaacggacaatacttcacatgccaagccatgagctcttaatcataatagtggagggagggcatcattagtctcatattggttgtaaatcaaagaagatcctagcttatatgggatgggaccttttcttctctgtgacgccccatgccatgtcaatcaaagatcgaagtggataatacctcacatatacaagaacggagatcaatctacccgagccatgagcccttgactgcaatattgatgtgccagataagggacctcccctacgactgtggggcctatccctctgtacatagactcttccttgattatagagctatattatggtgtaagagggaggacatcattaatcttacataggttgtgagttaagagagactctgatttatatgaaatggaatcttctctcctctgtgaggtcccatatcatagtggctaaagatcgaaacgaataatacatcacatatgcgggagtgcagactgacccatctgagccataggctaacaatattatcatagaatcatgatttgtagtgagcattcatctactattttttttccagaactcatttcaatttatctcaattttcatgttttaaaagaaggatagatcttgcccaataatacatataatatttatgaaagtcctatgaaagccttattgtagtcagaaaacaaggtcaaaaatacattctagtctatggttgagaacttcaaccaattgactacgttgcctgaatgttcaaaagaattcaatagttcaatcaacaaatagagatgggatcatatcatctttttatttcatcaattttgctgaatgatatctataatatatatgtgccttcgctctaaaaatctttggcctaagttcagatttatgatagcaactcttcaaaaaaccaaaaattgtgatgacaactgttgcctaggcgacatgtaagtggttaagattgaaaactctaaaatagagtgcagctactctaggtaaaagatcactgacatagacatacatcaaagttcgtctgctccttaattatttcttttactaaagtagatgttgaatcataggcgaacaatactactgaacaatacatatttcttgcatacattggcttgactattagtgctatgcactctaggttcatttatacttcacaagagtttttatttgtttgccaacatcaaatttcatgcaatcaaaaacacaacttgcagaaaaaatgaataagagttaagtaaaaggacctaattatcataagctatggaagacaagacaagggatactgccattgatactcttagtaaaatagtgttataagtgatagtaatagcaatatgaagaaaagtatgaaagaactagttttttcttaaaagagtatgaaatgcatacaagttgcggtatcatttgtgaaagagaaagtattttcttttatttacgtttagtcaaaaccatatttatttgttatagctgatccctgaaatttcataactcacaccaattggcatgatgttattagcttagatttgccattataccgccattggtaagaacaaaatgccctcaataccaaaataaactgcatttgcaagttatttgaaagaagtgcaactctattattgtggcatgttaacgagcttttctataatttgaattttttgtaccgtctatgatggttatcaaattgtataacgaaggcaaaaaactatggctaaatgattcgtttttatgaattattgtatgctactcatgctatactttgtttgtttcatcatgatcattacctgcaaatcatctactcgcatgatacagctacgcatttgtcacattccgaacctagcatctgggtcagccatgcgatggcctcatattccctaaggcaaggctctaaagaatatacaaagtcttaacttctttacatcctcaaaatcacatgagcactattgatatcaatttaaaataaatatttttaattaataaataccaaactttatacaatttatagaactcaagtatctgattggtgttgataatgctccatctaattaattccttcaatcttgatctcaactataaccaaaaatacatatatcctatgactcttaaaaagaaaaggaaaagaggagatgtaagctttacaatccaataagaattttcacacaccaacactaatataataataataaataaaaaataagtaatagttgttactcttataagtcttctgtcacaagataccataataataaaacatgcaaagaaagtacatctttttatataataaatcatattaaatacttttctcaatttatagttactggattcgataatatttaggtactcgacactgaactatcacaatcatgtttctggctcatggcaagatatcgacatagtggctagtctcctaaactatcacaatcatatttttgatcagtggtaggatatcaacatgatggctaatctagagggccatatgtgcttaactctgactactacagctagattttcaatctatgatcagacactaataaagtagcttatctaaaggattataagtgctcaattctaaactatcataatcacattttcagattacggtaaggatcaatatagtggcttatcacacagactaccacaactatatttccagcttgtggtggggcatcaacaatattaatagcctaaagcaccacaacccactattcagttacacaattcaattaacaattcaagatcatactcttttgtaaaattcaatacacaagattatcgaaactactcaagttaggattagtgatatatgatacataacttcatacagatctctctctatatatatgtatgtatatatgtatgtgtgtttgtatacatacaattaacaaataagcacatagcatgcaactatcaaaaatcatataaatcaaaatcactatgcacaaaataattgttatataaatagatgatcaatgtctagaaatttttcgctctacgtactgatgacaaacttggttataactatttattagtccatgcctagcatgtccaatcaatcaatataatttcagttcatcctgaatcaaccattagcataaaaattaaataacttattgccagtgttttaatttcaaagctctaatattcgaattaatcttacttttaatttctctatactttctaattaaaaattacataattaaataaaaaatttggattttatcttgactataaactagagcataaaatcccttgctcagtatttcttaattggatgattggtcccatccaaaatcaaaatcaataattagaaagagccataaaatggttatcatcgatggtagaaaatttagaagaagaatatagctagtcgaataatagcatctggcaacctaagtgggtcaggtctggctgatttagctggttattcatgaatacaacaaagatcatctatgatagattttgaggttgcttgatcaagaccaaggtggagaaaggcaatgctagtagcatccagtgactagtgttagcccaatatacataatccaaatgattagtctacaaatcaaaagccaaattatagctcaataggaatttggtgatgataaaatcaaacaatgcttagcagggtcgggtttggagttaactattatacagaacaagtccaaaaccttcttctaggatcaacatagggtctactatcaagtcttcaaaatccatctttttttcttcttttttatccctaaatataagaagagagagaaaaagatagaggaagaaagctggtagaaagagatgtgagagagaagggagaaaaaaagaacaaaccaaatctctctctttctctcttcattatcttctttcttcaaaaaggggattttcccctttctccctctctttctcctagcggatggctaaggccagcagtctatggtggtgtctagtggtgaagatgcgatggccgcagtgctacagcgatggcagttgtcggttggtagtggtagtgggcgatccaatagaaagaaaaggaaatcaaaacaaaatagaaaaagaagccttgctttgatatgataagaagactacaaggtggtcagcggtaatgacaagcatccgcattagcttaacctcttatgatagttgcaaaggcaataatagccacagtggctgacggtggataaactaaagaaaacagaaggtccttagtgcggcaacatccgacggtcttccaagaagatttcagccaatgatggctgtatgaaaataaaaaagaaaaaaaggtaccaataagatgggaggccacgatgcctcgatcatctctaatgatggcgtgaccatggttgtgccaaaacttttttttcctatctttccagtgatatgatcaattgatcactgatcaatacagtggaagcttggctttataaatgatggaggctagggttttctagcctccgatgagttggagaaggagccagagtcaaactctttcttcgactcaaataggggaagggaaggtctttccttccttcccattgtttcttgggcttgatgagatttttattttagaaaaatttcaagcctctacaaccatatgaaatcataatgtcaaagctagaaaaggagatctatgccataatattccaattccaagcctaatcaaagaaccatcaatccattaacactaactttaagatacctaagttctccctagcattatctatggtaagaaaatctattaattaaaattgcataattatatctaaatcagtcaaagaacaaataatattctctctttctttatcaaaattatactcctttaccaggaaactaattcgaatcttccataatatcttttggatcaaagaattaatgtatttaattagtttcaaaataactcaaaccatcacacttctgctatacactctaatctaaatccatcgattcctctgggttgactaggtgaattctaacaaaataccgcttaatatcggaaccaagaagatccaaaattttaacttaaggcaaactagaacaaaacttttgcatctttttatccttacaaaatcttgagcataccacatcaaaagtaaaccttgagccactatccatgtttgaagcatgacataagcttcgccatcctctcaaaacttaataactctagataaatttaaattaatcctgacttctctaacagttcaattagactatcaagatcaccttttctcttggaaagttaactcaaaattctaacaagttagaaaactctaaatcaacattcttattaacttgtttattttttatagagcttcgttcactacaattcttagtatcaatcgacaaaccacatgaacgccccttatatgttagacatatacaagtccaccagaatcaatttctctactcaattaaatatcgatagcaagatactatagacctgctcataagcctaactctgattagaatttaacacatccaactatctccaacaaatataagaaagaccaagtaagctgatctaaagatgataatttaaattatcaaagattctaccaagatgcatatctcatatccaattgataaaatctaatccattaatagaatcaaacatacttttcttttacatgccagtttcatatatgatcttcttataggtttgattctcgaagaatgtttatttttaacactatgtaattctttcttaggccatatcctaaacaacttgctagtaaagtctaaaattttaatgatcaaacaattaataataaaattaaaaaagttattatgatctccccctatattaagtttagaatttcaaaaatatctaagtgacaattgagcaagtacacacagcataacacaatctaccaatatatcatactttattctagggtctacagctcctatacttaggtcaaatcttacttattgaaattagagacataacttatccattccttttgtactcataatatgccaagtcttatgcataaatttttatcataatgcttagtgagcttaaacctgagctttgaatctatttctactatgtacattacatccctagtgatcacaactttaagttcaaatatcaattaagttataatccctaataatcataacctagctctgacactactttgtcatatctcgatcccagcatctggattggccacatgatggccgtatactttctaggacaagatcctaaagaatatgcaagattttaaattcattacaatcttaaaatcccatgagtactattgatctgaattcaaaatgaatattacacattaacaaataccaaaccttgtataatttataaaatttgatcatctgattggtattgatgatattccatctaatcaattctttcaaccttgatcccacctatagtaaaatacatatatcctattactctgaaaatgaaaagaaagatgtgagcttcatagatcagtaagaattttcacacatcaatattaatataataataaataaaaaattatcaatagttattactcatataaatctcatacaataggatatcacgatcataaaatatatataaaaaaatatatttttttgtataataaatcacatcaaatacttttctcaatttatagtgtatcagatcctataatatttaggtgctaggctctaaattattacaactatattttccactcatggcatgacatcgacatagtggctaatctcgtggactatcacaatcacatttttagcatgaggttggacataagcatagtggctaatctagagggtcataagtgctcaactctgactaccacaatcatatttatagtccatattgggatatcaataaaatggctagttcagaaaactacaagtactcaactctaaactatcataaccattttctagcccataatgatgcatcaacaaaatagcaagcctagagcaccacaatccaccattcaaggacacaattcaattaataatttaagatcatatttctttgtaaaatttaatacataaaattaccaaaaccactcaagttgggataagtgacatgtgatatataactttatacagaatcatatatatacttaagaaataaatgtatagcatataactatcaaaaactatatagatcaaaatcattaattcacaaaaataatttttatataaatagatgattattatccagaaattcttatctctactaatgacaaactcggttacaactattttcttgtccatgcctaatatatccaaccaatcaacataattccaactcatccttaatcaaccattagcataaaaaataaataaattactcatagtgttttaatttcaaagctttaatatccaaattaatcttaaatctaatttttttgtactttctaatttaaaattatataattaaataagaaattaagattttatcttgacttgtaaactaaagcataacatttcttgctttgcattttcttattgggatgattgctctcatccaaaatcaaaaccaacaatcaaaaaaagctataaaatagttattgtcgatggtggaaaacttagaagaagaacagttggtcgaataataacatccgatggcccaagtgggtttgatctagatgccttagctagtgattcaagaatatgacaaagatcgtctatgatgggtttcgtggttacttgatcaagatcaaggtgaagaagggcaagattagtaggatccaatgaccagtgtcagcccatctaggtgatccaaatgattaatctataattaagagccaaattatagctcaatagaaatttggcgatgataaaatccaacaatgcccggcaagagtcgggttaggagtgaacaattatagagcaaacctagaatcttcttttgggatcaacctagggtctaccatcaagtcttctaaatctatctttctttcttttttttttatgcctaaatccaagaagagagataacaataaagggagaatgtagagagagatgtgagagagggaagaacaaatcgaatctctctctctcttccttgtcttctttcttcaaatagaagattttcctttctccctctcgtcctccaaacatggcagtggatggctgaggccaatagcctgcgatggcatccaacagtgaagaggcgacaaccccagtagcaacaatgatggcagctggtggcagcagtgggcaatcggatataaagaagaagaaaatcaaagcaaaataaggcaagaggccttgctttgatccaatgaagaggacttcaaggtaatcggtagcaatggtaagcatctgcaccagctcaacctttggtaatggtcgcaatggcaataatggccatggtggccaatggtggatgaatcaaagaaaataggggatccttggtgcggcaagatctaatggtctttcaagaagatcttagccaacaatggctacacgaggataggaaggaaggagagaaagtgcccatgagatgggaggcgatgcctcatctcctatgatggttcaaccacgattgggctaaaacttttttctcctccttttttgacaatgcaatcaattgatttctcaatagaatggaagctcagctttatagacaatggaggctaaggtttcctagcatccaatgagtttgagaagaagcaggagtcggactccttcgactcaaacaaaggaaaggaaggtctttccttccttcctattgtttcttgggcttgattttgggcctatttcgatgatgggctgggtagggtatcacaacagttttgtttctaaattgtcattatcaggaagagtaattctttgtacaccacattcgatgtagaaaaactgcaccactccgcctaattgagccacatataaccaccacttttcaatgtaatttagtattcgcaattctgctttttttttttgaaattttgaatggcaaaaatgtccatcctcttttaaaaaaatatgatatcttatggccatattataatatcctgcaatcaaattatgatttcttatatacagaaagttataatttgaccacaggatgtcataagaaaggggtggacattttcatcatttaaaaattttaaatttttaataatgaaaatgtcctttcctttttatgacttttggaagaaaaattatgacatcctatgtgtattaagacataatttgaccgcaaaatgtcataatttttttaaaaaaggataagcattttcatcatgcaaaatttcaaaagaaaaagcagaaatgcggatattaaatacacattggaaaacggtgcattacatgactcaatcagatggcgcggtgcattttttctacaccaagtgcggtgtacaaagaatttctcttactaggaaatatcttgagtctagaccggcccatttgtcatttagaccaatcaaggactatgaattttggtccataataagtatgagatcgtcatgggattgaaaaagatgggaaataactcctcagtttgccccttgacagctcacaattcttcaaataatagcataaatcattttttgaatcatcaaatttattacattttagccttttagaagaaaccaatgctatccatataaaaggtatttgttttctattaatgtcattgcactaatgaagacagcttcagcaaagatagagcagaaatcctttaaattttgtaagattcatttgatcatcttgaattttctttgatgatgtggttgcagcaatactatcagcaggaatcagcaaagttgcgccaccagatacagattttacaaaatgcaaacaggtgaacctcaaacttagatcagaactgattggtctcaaatacaatgtatatgcattttcaaagcttaagattatgtcttaccatgattcctaatctaccacctctacctttcaggcacttaatgggtgaagctttgagcactctgactgtaaaggagctcaagcaactcgaaaacagacttgaaagaggtatcacacggatcagatcgaagaaggtaatctgcatctatattttcttcaaactgagatcttcatattgccaccagcacatggcttatctgaagtacatgattattaatcatgaaacatcatgctatgcagcattgaaaagggaaatcattgtggttcacaggtgggggtagagcatgtaagatacgatgggatctaaaaatcgagtcaatataaataagtgtaatttgtattctgttctgcccccagaaatcagcataggcaccatgatgcatgtaccatcacctaataatatgcaacttcagaattttttggcccatccagctctttaatttgatttttgatgcatctcattgtttttttcgcatcagcatgagctgttgtttgcagagatcgagtatatgcagaaaagggtaatattctaaacttattccctgcaacttaattcaaagtattgatttctttcattcatgtctccctctgagtggttctttgttgttgaactgtaggaagtagaactccaaaatgacaatatgtacctcagagctaaggtatcaatgagaacaaaactctcttccttgtccttgtctgctatttctttctgatataaacaaaagaaatggatatcatattcgtaaaatatttgatatcatctatcatgcttttagacttatatgtggtactagcatggagccaaattatatgcattttcatatgtttagaatgcatgactaacgaaacagtgacttatgtttaaaatgcattttctcattgatcaaatttttttttacatactgttgaatttaacagaggagaatagtttccaagagatattacaaaacaagagtttatttgtatttgcttgtcttcaagaaatgaattcagctccactagtggtaatcatgtggtcatcatccatagtggcctgtatggcatggcataaaaactaggtgagattgtaaacaatcttcatgatgatagtatatatatcatagaacattgagcctttgtgtggaggctcatctgaaaattagtcatatctgaatgagaaccagattgatggaccgtttgaatcaagagataggacaagcaatactcgaaaaagtgccttagttacagcccaaattctggattgctgatttctctatttatcgatgcaccaacacccttcatgggcaagaatattgtttaaatcagtgttgcatttgacttcaaacctctaacatctcaacaaccataactgaagccccttcaaagctaaaatgcctgttaatttgttcttcacaaagaaaatggcattttttcctagatgtccataccgatactaacggtattttggaggcttgatgatgtgctaatgacactttggattcctcaaagaaatggctcctctgctccatctcggtcacaagtctctaaaattttcacttgttgtttccattgattctatttctttatattttatttagatcttcacagacacagtctcaaagtagcaaggtggcatctacattcttatttctcacttcaaaatttttggtgttctcagatagcagagaatgagcgagcacagcaagcaggtattgtgccggcagggcctgattttgatgctcttccaacgtttgataccagaaactattaccatgtcaatatgctggaggcagcacaacactattcacaccatcaagaccagacaacccttcatcttggatatgaaatgaaagctgatccagctgcaaaaaatttactttaagtatgtcgctgcttgttaatgacatgttctaataacataggctacaagacctgtactcttactgataaaggtgtgttagaagacttgtctgatttctatattcctaatatcaatagacatgttagtgtgccttaatttgtcttgatttcagtaatattttgcagattggaagaaaaagcacttttttattcatagaagttctctccaccaaccatcatctattgagtagatcagagtagcataaatgacatgtgtatgcatatcctagagctataattgacatgccaaatgaaaaacctaaaatgctgaaaggaatctccacaattatggaggaattagtacttcttagaccacgaagctaaaactagatctgcaatcctcataaagaatggctaccccctactgccgagtgtcaccaaaacattattgaagttgctaagccaagccctcaaagttctcttttgctatgtttctccccagctgcgagcttttgattttgttgcttcttcaaagatcatgtacatgtaagtggtttcttttgctgctgtctctcggatctttttgcgtgatgcatataggcctggtagatcaccaaaaccagactcgccatttgtgtaagtccaggttttccagtagtcctgtgattcttgcctccagctaatgctttagcagaccattgcaagcaaatctctgtcagcaactatatggtcacttggagtagatggatattaaacatgcttgtctttttgcttatagccttcaatttatttgatattatagtattaacccaagctcaagctcgactcgatgaaaaatagacaaaactcgagttgagcttgaatatcaatggagttatactcgagttcgagatcaagtcttagcttactaataagatatatatatatatatatatatatatatatatatactaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttactaataatatatatatatatatatatatatatatatatatatacaaactcaaataggctcataagttttttaaactgagtatcctgttattcaaggttgataataatcgagttgagtcaagcttgaatagtttataagcaactttgactcatttgtatacatcgtaagcttctaaagatagccataagagatcagagatgtccatgcctgtggtaccaacctatggtaagcattaaggagggtggtaccaacctatcggctgaagtttcgttggtgaatgttaatttttgcaaatctctaacactataatataaaaatctctaggatcttacatggtcaaaaatggttgtagacgttatatgctaaataatgtgttgttgtccatgtcaggatctaatgaagaataaccacttgttttgttgtgagaatctaatcagtgtagtgctatacaagccaatgatctgtatttaattagctcccagttgctagatggaatcgtactaaagtttttttttttttggattgaaggtactaaagcatttaaaaataaaaaatttctcacaatccggcattagcttagttggtagagcagaggactttagttggtattaatcagcaatcactaggtcgcaggtttgaattcggcaagttagattttttaaattaaatgccaattatttgtagttttttctaaacaatttgacactatttttcaaaattatgcaagacaaaaattgaaaaattccaaggtgtcatgttatcctttaaaatttttacatcataaactttaaattataatttacaaatatttatttcatttacaacaacagaacatatagcatgagaagaattatgcaaaagaataactaagaatttctgataaaatatacacctttttctgaccccaatttatatcactaaattcaaagatgaggattatgcaatgttggagctagtatggctgaaaatctaacatccttgctaagcatttctgctttaggaaggctaatattcttgaaaaaacaaaataattggcttggggtttaagacagcttcaaactgggagtggcttacatgtatacaatcagaactactataaaagccatggaagcaggatgggaaaaaagaaaatgatttagtaattttttatttatatttaattttttttattaagctatcaactatttccctaaatatcataagacccacatcaaagctattaaaaacaaataaaggttttgcatcaatgtattgggtacatcccaatcttatttctcaaaaatgtttttgtgtcaacacatctaacaatatcattgtcaaacttttatataaagcacctactacacaagctatactacactctgcaagttaaacccatttatttatcaattttctgccaaattatttattaattatttaaacaaaaaatttaaattactataatgctaaacaattttatagctacttaaaagaagcatgttcggttgctaaactatctcacttgcacatatcttccgtatactttatatcattccaaatttttttcataggacttatttggacaatcgggaaacatgttttctttactatgaaattgcattcaagagtattgacaaatcccattgtcttttttattactaaatatgcattttgtatgctcatatactagtacataaatctattggttttttattctcttggttagtataaattgactatctcaagatagcaattaatatgtattatattattcaatacttttaatcttgcctttgctatgccgcttttagtttctttaatattaaatatcaaatgaaatgataactaatctcattttagtgatattgcctgacattttgatatcctattcttcaatatcacttgagatatcaagatatcttgactatttaagatctattttctattgaaatgaaggtaaattggtatgttggtttgtcttggttagaaatgaatttgagacttaaaatttcaatagaatttgatgaatgatttaacctgaatatataaaaacagcacgcaagttagctgatattcatccttttgatcttgtttcaaattatttatcgggataattgatatttatgtatttataaaacaatattacaggtaagagaaatcaaaatacaatgattcactccacattcctatcctccacatccaaaactcctcaaaattaaaaccaaactctaaaatgctctctatatattaaaatttcaatgtagcttttgataatgttataaaaatagttgttttgatataaatggttgttgaagctcatatggatgatcccttagaaactggagtgtattataaatgatcgttgaagctcgtatggatgatcccttagaaactggagtgtattataaatgatcgttgaagctcgtatggatgagtccttagaaattgatataagaaatattatttccttcaaatgaaaaatattattcccttggtaaataaataagaaatattatttcttttgtaaataaatgaaaaatattatttttctttataatttagattaaaaatctataaaagagcttggaatgaaatgagaattgttgcggccaactctccgtcgcctgtcgccggtaacgagcacccgcaagacagcatccacatagaccgaattgatgtccgacgaagaccctccgatgcttaagtcagataaggaagttgatgaacaataatttttgaatgtagaaagtagcagagttctggccctgagatggcttaccagtactgctcacttaacccctttttatagatgcttttgatgtaaccgtcgagcacatagtcccactttttatgacgctaaattatcgggccataaatataaaattaatgaggcgttaattctccttaatagccgtgacacacagttgataaccgtttgtgacggttatgatatgttgagcagattagccgatcatatatcggtagaaccgactatatgtcggtagaatctatgagcgaccatcggctagtagttctgttatgccgacggtctaagtcattcactgtcgatcggtagtagtcgaatcattagtcggtcagccgatagtaagtcggcgcggttcgctcagtcggtcgatgaagagtcagaactgcatgttcaaccgatatgcagttggagtcgtggtgaccaaagtctgaggtcggtcagtttaccccaacagttacccccactctcaaagtccaaggtgaaccgacgtgtatattgtcacgtagttcgtcatattagatgaagggagttatttctatcatatcgaacctcgattttgatgtcgctttcttcgagatatgggcgatcgactgctttgtcgttgtggcggatacggtcatctttaaactgtcacactaatcagacgattcggtatcagttgtcagtgtcagacatcattttggaaaatcaattcgacgtcggatgatatgattctgacaaatagatttgtgccatatgtctgaatgttattgggtcggatctgtttacgcggattaggatgacgtggctcgatctggggcaaatacgtcgaaccatctgattaatggtcggtctagatgttgccacatgtcacatctgataaattttcgattcaatcaccttcatctccactgttgagggatcctatatatataggatcgctctcaaccaaacttctacttttcattttatctttcttggtgccgaaactctgtcggacagtcgtcccaacgtctgaggttgttattttcgtctttttcagatcaagtttctgtcttttcttgagtcctttttctttcagaatctccgtcttctttagaatcttgtctcttatggctaggacttcttcttgggacggtcggttggagaatccgactgacgaatctcaatcagatccagaggttgaggtttcttcacttttggagtcaaatatcgagcagcttcaggaacagtattgtatcccggagcagtttcagctttttgcccctagggctgatggtcggatgaatatcccttttttgggccaggtggccttctatgtcgaagattttcgagtggatcttcgatttttgattttaaaatttatccgaaatattttggattactacggactttgtctggctcagctggcaccgaacttgatctggctggtaattagttttgccttgttgtgtcagttgctaccgactaaacctcgtccttctctttttcgagttttcttcatcctccgacctcatccgaagatccgagggtggtggttcttcaaccctcgaaaagatttttcttttattactgatcttctatcatccattcatagatggaagaatcaattcttcttcgcttcctctacccttccttggggttttccttctcgttggagcgatctacgaactgattgcacgacaacagccgagtagagattgacgatcgggaggacttccattgactgaaagacatgacggtcctggcacagaaggagcttgtgaacgaacagaccctttatgatgccgaccttagttcgattgcccgattagatatagtacagtcggtcggttatttcggactttacttttcttttacttgtttagttgtactgacttctattgtaattgcagccatgtagccgagggtgcgagtgtcgagcatcgatatttgtcagcacgctgccaggaagagggcagcgtccgaggttggaccttctcgaccatcgatgaggcatcatactttggtgcaagttcgagcggcactagcttcagtcgtcgcttcaatgccgactgaggaacccgatgctccatctgcatcggttcctgagccgatcccgatactatcagccccgacagtgctccctgctgcatcatccgaagaaagggtggcaaggagaactgccgaagcaccatcggtagttccatcaattgaggaggtttgggtcagggctggagaatctgaacaatctgtggctgcgccagttgctccttcagctggggcgcagtcgagttcaagttttccctcgctttcgaacatgggactgccggcaagggatcgggggaaagctctggtgacttcgacggaagatgcagcatcggagggctacacggttcacttcgaccttcaagtacctgatgataaattgaccctggccaatccgacattggccaagcgactgtgccaagccgctcttccttcgctttatcaggagcatcgaaagaaacggacagtggccgagatgttttcatccttttacttgatgataattagggtaagtttcttttcttctttttttcttttttttaacctaacttatcttctgcttgcagttgatctacgatatgtttgacctggaagtcgcctatgcgaaggttgataattttcgtaggtcgtagatgaataaggtggcagccgtcgatgctgagaaagcggccgcactcgaacaacttaagtcgacagcggagcgggaagccaagcttcaggaggagattttccaactaactgatgacttagcatccttgggggccaaacttaagttggctcgtgaggctatttcggctcttgagtcacaggtcaagagcaaaaagcactctatccatcggcttcgatgggagcgagacggatgcatcgaagaacttaaaatcgaacgtggatgtcattgggccagcctgaaaagattggcactggctgaagaagagtcatcctctgctcgagtcgatgctgatttggtgaaggcggaagcggagtcggcaagggaggtattgagtcagacaatcaaggatttttggagttcgaaagaattcaaggaagagatcctcgaaggtggcttcacctcgtactgtgtcgggtatgaagacggtcgagatgcggtcagagaattatacccgaagctcgacttgagcagtatcgtccctccaagatcggaagatggggttgttgaaaaagaagccgcaccgactcaagatgaagcactgactgtgcctgaagttattcaaattgccaatactacaccagagcaaaggaataagaacggtgatgaagcttagttgatgtatttcgctttcctttttgggtaatcaaatacctataatcggacttcagtccaattttgtaactttttttgacaatgaatgaaagtattttcttctaagtttaaactgtttgtctagattattaagtctgcaatgtctgcaatgtaaagtagccatcgaatattaatcggtgatccgatcattcgatagaacatgtagaatatccgttagtcgcgtaatctttgacatacttaatagaagttaggataacgatggtaagtcgaatatcctatacccgatacttgatcgagtttatatgtcagatcatttgataatcggtggcaagttgaatatccttcgactgaccgtagccatgtcagtataatttcaatccgaccttgatcatttttgtatttcattctgcttagttaagactaagtcggcatattagtctttcgactgtagtcagtttttatagtggaaagccaacattaaaaatcaaaatataatcggtactacagcttttgcagtgaaagcctatatatttgatgtcggtttgaaattacagtcggtatgtcagtttttgtaagagaatcaaaatatagtcgacactgaaacaattgattctctggcgtttacagtgaaagctgaaataaactctatgtcgaagtacagtcgatagtttggcttttacaataaaaaccgacatataattaatcattgatagaacttgaccaaggtttctgattataatactgaagattctgtattgtatttcaaataatatatatatcaacaactttataggtgatacatcttcagattgtcggcatttcatgttcaaaaaattatcgatccttcaaggatttctaaccgatatgcatccggtctaagagtttcggatattctgtaaggtccttcccaattcggagacagtttttcttgatctaaagattttgagatttcagcttttcttaagaccaaatctcttggttggaagaccttcggcttgactcttgtattataataccgggttattctttgccgatatgcagccatccgaacttgagcttgctgtcggagttctgaaaggagatttaagtcggctcttcgatattcagaattgctcggctcactgtattgttccatccttattgatggcaatccaatctcgagcgggatcattgcttctgttctataagccaaattaaagaaggattctccaatcagtatccagagagttgttcggtacgcccataagatcggatataattcttccacccagaggcctttggcttcattcagtcggatcttgagttcgtacaagattattcggttggttacctccacctctccatttgaatgtggatggccgactgacatgagtttgtgtgtgatatgaaacttcatacaaaactctctaaaatttgattgtcgaattgtcaaccattgtcggtgatgatggtgtgcggtaaatcaaatctataaataataaatttctaaatgaagtcttttattttattttcagtgatttgagccataggttcagcttctacccatttgatgaagtagtcaatagtaatcactatgaattttctctgatcagatgccggagaaaaaggatcaaatatgtcgattctccattgtacgaagggctatggtgctacaatcgatgtcaactgactagccggttgatgttgtatatttacatacctttgacatggttcacacctccagacaagttcagctgcatctttcttcatggtgggccaatagtatccttatcgtaggactttataagctagagatttatctcccaaataattttcacaaatctcttcatgtacttctctaagtgcatagtcggcatctgtaggtcccaaatactttagcaagggaagtgaaaatgaccttttgtagagatgactattcattattatatattaagaggccatccatcgaagtcgattggcttctaaaggatctacagaaagaatctcatcagtcaagtattggacgatcggatccatccagcttggttcgatagtgagctgcaatacttcctcgactttgtcgatacttgactgttcgaggcattcaacgaatgtccgacccagtgagttgaaagcggtagtagcttatcatgaaagtatgtcggctcgagtatttttgattctgaaaatatgaaagatcttgaaatatttcaagcttgctgtaatatctttcactttctaaagatactttatcatagtggggtctcaggcttcaattcacccttgacttgtccaacaatccattgtgagtcggtgaagaccttcaaactgtcgatctcaagctctttgactatcttcaagctgactaagagtgctttatattcagcttgattatttgaggctttaaagttgaaccgaaggacatattcagtgactactcctttgaaatttgtgaatataagaccggctccactatcttgtgtattagatgctccatcgatgtgcagcacccaggtcaaccttaggtcgggttcgggagtcgtaacctgctttattatattagcatctgtatcatctggcttattgtcagatattgtacattctacgatgaagttggccagaacttacgtcttcatggatggtcgtggatgatattgtatgtcaagctcgccaagctttactgcctacttcgtcatgcgacctgacgtatcaggtcgatgtaagatcgtcttcaacggctgatctgtcaagaccataattggatgtgcttgaaagtacgaacgaagtcgttatgtcgatatgattagagtgtagatcatttttttcgttcttgagtatcagacttcggcattgtgaagtactttactggtatagtagatcgatcgatggattcgattttcatcttcttggatgagcaccgaactaaccgcttctgttgaagtcgccaagtagagatacaatatctctccgaccttcaattttataagtaaaggtggagaagtcaagtattttttcaagtctttgaaagactgtcggcattcatccgaccataagaagtcctttgtctgtcataaaattttgaagaatgacaaacatcgctcgactgatctagaaatgaatcgactgagtgcgacgatccttccattgagttactgtatctctttctttgagctcgggtacttcatgttaatgatggcctttatcttttcaggattagcctcgattcctcattgtgaaataagaaatttgagaaattctctgaaggttaccccaaatacacacttgatcgggtttaacttcatctgatatcgtcgaagtgtgccaaaggctttctccagatctcgaatatgatctgaagtttggagactcttcatcagcatatcgtccacgtacaccttcatatttcatccaatctgggccttgaagatcttattgacgagccgttgataagtagctccgatatttttcaaactgaaaggcattactttgtaacagtatatgcctttgtcggttacaaaagtcgtgtgctcctcatcttttagtgccatccagatttgattatacccgacgaaggtatccatgaaactcaaaaatcgatgacctgaagtcgcatcaatcagttaatcaatctttggcaatgggaagctatctttcagacaagcttcattcaaatccgtatagtcgatgcaaattctttatttttcattggcttttctcaccgttaccacattggcgagtcaatcgagatatgtagcttctctgatgaagcctgctgcgagaagcttatcgacttcatcatcaatgatcttttgtctttcaggggcaaaaggtcgcttcttttgtcccattgacttaacgttcgggttgatgttaaattggtgagttattacttctgaaggaatttcgggcatgtcagtggccgaccaagcaaaatatcagcattggctctgagtaattttattaattattgccgctctgagtcggacagttgcgatccaatttggattattttctggggatctttttctttcagcgagatagaattcagttgttcagctggttcatccttttctgattctctctttggtctaatttatcgatagacaaagagtctttagacttattattttgggtggagacaaggaagcagcatcggataatttattgatctccatgcatctctctaactctattttttgtcaaaaatcagactaataaatggtatgtcgaaatcactgctttcagagcattgagtctagatcatccgagtatggcattatgagccgaaggtactcgaactatcgtgaacgttatgaagatggtgttctgttgtggttcagttccagcgattaaggggaggaagattttttcttccactgtgacagcatcttttgtgaagctgactaatggcgtcaagactcttctgagtcatcagtcggtagtcgcattcgagagaaagtcgaataaaatagaacatcagttaaacttttattatctacaataattttttttacatcataatttgctattgttgtcgagacaacaacagcatcatcatggggagtttgaattctccaaacatcctcttctgaaaaaattattacattgttgagtcgtcgtcgtttcaccgactcttcttcagtagttgccctcaagtccagtcgttcggagatcatgttgatcactcctgcagtcggctgattatttacagcttcctcagtcggctgaggtcgtcaatcggtaggaggttgagttggcggatctctccgatattttttgaagtagcctcattaaatcagggcttctatctcatccctgagttgaatgcattattcggtatcatgaccatgatcacgatggaaccgacaatacttccttcgattgcgattccttaatgatgctttcatcggtggaggatgtcgtaggtattctactccttcgatctccattaggatctatgcacggagagcaaaaagaggagtgtagaagtcatacctgctgtaattcagccttggactccgtcatccgggcgaagcttgcttattggatggcggccgacttgattcagccagagcttctcccttcttttgtttcttcttcttctaaccgttgccttttgtcgggcgtcggccagaagctccttcgtctatgtgcatatacttgtatgcacactctagaagtttagcataagtccagaggagagtcttgtccaaagaatatgagaatcgagatctcctcagacctcttttcatggtcgatatggccatgtcttcattgaggtccttgacctcaagcgtggccgtattaaaatggaccataaaatctcaaagtgtctcagtctctctctgcttgatcgagaagaaattatcagagatttgtgacggccttcgactgctactgaagtgagccacgaaagagtgttcgagctatccaaaggagtatatacttttcgattgaagctcgaagtagcagaccaagcagctttctgaagagtcgctggaaagtcgatgcacaagagggcgttggtcaccccctgaatcatcatgagagccttgtagctctcaagatggtcgatcgaatcagtggagccgtcatatggctccacttacagtattttgaactgagatgggatcggctcgtccaagatgtgtcgagagaaaggctggacagtgtgaaagtcatagtcgttggaggacttccgatctttcacctgaagctgggcgagtcggcaattgattttttgaaacttgtattcgtagtcgtcaaaccatcattgctggaaaactctgagggtagaactccctgacgagcttgagggagaagcagaaggtatccgcgatcatttttccttcctaatacggtcgagatgggaaggagaggaatgtcgcgagtggtgggtggcacggcaagagtgccgagaatgccgctattcatctcgatggaagagccaagatggtcgctctagagaaggagaaggtgatcgtcacggatgacggtggctgtgcatggacggcaccgactttgccaccggttgctccgtcggcaactgctgctgggtttgctgttgttggaggcttttgactgcctccataagaacattcatttgctgcacaagcatagtgatctggacatccgtaatgatcacgggacgtgaggaactagactctgctattggaagaggagaaggaacctctttttgatgggaagagtgcctcgctgatccagttgcagttgagtgttgggctctggtcttcgtcatggtgtgtatgatctttaccccttcctgacataccaatctgttgcggccaactctccgttgtctgtcgtcggtaacgagcatctgcaagacagcgtccacacagaccggattggtatccggtggggaccctccgatgcttaagtcagagaagaaagttggtgaataatagtttttgaatatagaaagtaacagagttctgacctcgagatggcttaccagtactgttcacttatctcctttttatagatgattctggtgtaatcatcgagtacatgatcctattttttatgatgctaaattatcgaaccataaatataaaattagtggggtgtttatttttcttaatagccatgacatgtagttgataaccgtttgtgacggttatggtattttgagcagattagccgatcatatatcggtagaactgactatatgtcggtaaaatctatgaatgaccatcggttagtagttttgttataccgacagtctaagtcgttcgctgtcgatcggtagtagtcgaattattagtgggtcagtcgatattagtcggtcagccgacagtaagtcggtgcagttcgcttagtcagtcgataaagagtcgaaaccgcatgttcagccaatgcacagtcagagtcgttgtgatcaaaatcaaagatcgatcggtttaccccaacaagaatgattattatcgtgtaaaaagattttctctctctctctcattctctcattgtgtctctctcctttcattatatattttattattctacaacacgttatcagtacaaaaagttttccaatctagtgctgcaaggtgtctccaagtagaaggaagtctcaaatttgaatccactttggtttgtttttgaaggtatattttaagttttaattacattttttttgaaaatattaaattctcacaatctattgggttaatcctcctcctcaatctctactaagggaatcttgaggattacttccagaagccttcacaggttattcggttgtagattagatctataaaggacataagttatggatgtttatttactttataattttcaatttaaatatgatgaatctggtaaattggcaattcactgcccttgatattacgggcaagaattacctatcttagattctggatactaaaatgcatcttaatgccatgaattttagaaccatgattcaagaaggaaatattgcattcctgcaggatcgcgcaaaatctttaatttttcttcagcatcatattgatgaaggtttaaaggttgaatatcttactataaaagatccactagtattgtggactaacctgaaggaaacatgtgaccaccagaggatggtcattctttcaaaggtacggcatgattggatgcacttgaggttgcaagattttaaaactatgtctgaatataattttgctctattctgaatcagctcacaattaaaactgtgtggaaagaatataacagatgaggatatgttgaaaaaaatattctctacctttcatgcctcaaatatgctcctacagcagcagtatcgagaatgcagatttaaaaaatattttgaactgatttcatgctttctgatagtgaagcagaataaagaattattagtaaagaatcatgggtctcgcctaaccagctttacatcattccctgaagtgaatgctgtgtcatcccaaaataatgagcatgggcatggatgaggtcgtgggcatggccatggtggtttcaaaaatattgggacaagctacttgaagtagtaaaatctaaaaataggtacaagctctgatcaagagaaaaagatacagtcagatgaaaatgtttgctatagatatggaatgaaggatcactgatcgcatacctgtcgtatgccaaagcatctgacagatctatatcaagcttccataaagagaaggaaaagaagcttgagacaaactttacagatttgtttaatgatgatgatggcaatccaaatgtgcctccttttgatgtcttcgatttttttgcctaccctgaagaaaaaattgactacatgatcattgatggagaaatagttaaagaataatttttattgtatttttttttgataaaattattttatttatatacttatattttgaaattaataaataaattattttataaaattaatatcttatttattttctagattaaatctgaaaatgaatgcgaaagaattttgcatagttgatagtgctacaactcactccatactttgggatcaaaaatacttttcacaatcaacctttacaaataaaaatataagtataatttttagtacttctaatataattgaaggctccagaagagcaactataatactgtcaggtggtacaaagttagaaatcaacgaagctttttactcaacacaatctaaaataaatttactgagctttaaggatatccgccaaaatggatatcatattaagtctaaaagtgaacatagaaaaaaaaatttgtgcatcattttttatgattcaaacagaaaacttgagttaaaaaatttttttgttctttcgccaggattgtattaaacgactatttgtgcaattgaaataaatataatattgaaccagaatttcactaaaaaagaaatgtttattctctgacatgaacgatttggtcatcctggatcaatgatgatgtgcaaaattattgaaaactcaaatggtcatccattaaagaaccaaaagattcttctaattagtgattacccttgttctgcatgttcatttggaaaattgatacataaactttcattcacaaaattagcaattgaatctcctacattcttggaaaggattcaacgagacatatatggtccaattcatctcccttgtggaccatttagatattttgtagtcctaattgatgctttcataaggtggtcccatgttttgttgttgtctacttgaaacagtgcatttgctaaattgcttgctttgataatatggttacaaatacaattcttcgattttcctataaaatctatctgattagataatgcaactgagtttactttaaaaatctttgatgacatttgcatgttagttggaatcaatgttgatcatcttgttgctcatgtgcatactcaaaatgatctagcagaatcatttattaaaaagttgcagcttattgctcgatcattattgatgaaaactaaattgtttgtatctgtttgaaggcatgctattttacatgctgcatcactgattcgaattagaccaactacttatcataaatattctccgctataacttatagttggtgaacaaccaaacatttcacatttataaatttttgattgtgctatgtatgttccaattgctccatcccaaagatctaagatgggacctcaatgtaaacttagagtttatgatagtttcgatagtccatctatcattagatatcttgaaccactgacggatgatgtattcacagctcgatttatagattgtcaatttgatgaaatagtatttccatcattagagagagattaaaagatgccagaagcataatataagttatcatagaatgtaccaaatttatcatttcttgattcaagaacaaattagtatgaactagaaatttaaaggattctttatttgcaaagtatagcaaataatttacctaatgcatttatagatacaagaaggatttgcaaatctcatattctagctgaaatactctagctcggataaaagtttcaataggacaatcgatccctacgactgcagaacaacctacgccatgcttaaagcatgaaagatcgcttagtgcacaagataaaattctaaggaaaagaaattcaagtaaagtggtacatgaggaaaatgaaacttttgaagcaagataaattattgatgatgtagattctatggataacctattgggaatagtgtcccaaagccaatcgtcaacctgttgacgattgtgctccttttgtattagtacataaattataaataaataaaagttactttggtattttttcatcataaatgtttcatcttctaatgaactcctgtgttgtggtgaagtccttgggactatttagactcgataaaggaagatttgtcgcttagtccttaaacctgtttgcgaccaaatgatacgttgttaccaaggatgacaacgtttatcgagcataggtcgttgtgtgccatatgggttggttgtcctcataaccaaggagtgtggagatactgtatatggcatacaggtgagatataatggtatatttgtactgaacgtgaccgactccggaagctatttctgctgtcaagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacttgacgaaattgacaggtgaaaaaactgacacatgttactgaacctgaaccggatttgattagatcagatccggagcccattgattatgcatccttaaggcggtctggtagagtaccacatcaaccggacagatactatggttttttggtccgggatggtgatcctgtcgaacttgatgaaaatgatgaggatccgatcacctacatggatgcaatgcagagacctgactctgagaaatggctagaggccatgaaattcgaaatggagtccatgaaggtcaacgatgtgtggacattggttgactcacccgaagtaatgaaacccatagggtgtaagtggatcttcaagaggaagaggggcgcagacggaaaggtggagacctataaagcccgtctggttgtcaagggatatcgtcaacgttatggtatagactgtgacgagacattttctcctgtggcaatgctcaaattcattcggattatgcttgcgatatctgcccatctggactatgaaatctggcagatggatgtgaagacagctttcctaaacggagaactggacgaagaggtgtatatgatacaacttgaagagttcacatccacagataagtctaaggtatgcaagctacaaaggtccatttatggacttaagcaagcatctcggagttggaacatacgttttgataggacgatcaaaacatatggcttcattaagaacggagaagagccctgcatttataagtgggctaatggtccaatagtagtatttcttgtattgtatgtggatgacattctcttaatcgagaatgatgtccctgcattacagggaataaagatttggctgtcgtcacagttctccatgaaggatctgggagaagcttcctacatcctagggatgaggatctatagggatagatccaaaaggttgcttggcttatcccagtccatgtacattaatactatgctgaaaaggttcagcatggagaattccaagaaaggctatctaccgataggccatggaatttttctctcgaaaaaggatgtccgacaacacctcaagagagagagcgtatgggtaggattccatatgcttcgacagtgggatctatcatgtacgtcatgacatgtacacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaccaaattgttagaaatgaagaaattataattgagactcctgaaacagtccaagtgcaagaaaataatgagatttcaattagctatatattaaaagatgaaatatgggatcgaaagcaaattgttgttgataatgtatttgcttattcaatagcatctaatattgcttgtgatgatcatgagccaaaaagcattaacgaatgccaacaacaggatgattagataaaatagaaagaagcaattcaagtagaactaaattctctccacaaatgtaaagtatttagatttgtagttcaaactccaaaggatgttaagccagttggctataaatggatgttcacaagaaagaaaaatgaattaaatgaaatcgtgagatataaaatacgattagttacacaaggcttcttgcatagatctagaattgaatttgatgagacatatgctcctatgatgaatgccataatttttagatttttcataagtttagcagcaaaagaaagacttgatatgtgctttatggatgtagtcacggcttacttgtatggatcgttagattgtgatgtgtacatgaaatccttgaagaatttaaaatatctgaagtaaaatatttaaattcttataactaggagtggcaatcgagtcggatcggatcattaatgggtcggatcaatacagatcggatcaaaaaattatcaacctaaatccgacctgtttattaaatggatcaaaaattcaaatctgaatctgacctatttattaaatagataatctgatccgatccatttaatctatttattaaatagattaaattaggttaaatgggttaaacatgttaaacggattaaataagttaaacaggtcagattaaatagatcaaaaataggttaaacagattttaaacaggttaaacagattttaaacaggttaaacagatcttaaatgggttaaacaggttaaacaaattggtttaaatagatcagaaatagattaaataagttaaacaggttaaataaattatctaactcaatccgatctaaatattaaatgggttaaatgggttaaacggattaaatggatcagatatctaaaattcaaattcgatctaattattaaatagattaaatggatcgatccatttatgacccaaatctgtttagcctaaacctaaacctgtttatggcagatcgattatgggttggattgatgggtcggatcatattttttcagtcctacttgcaatatatactcagtcaaattacaacgatctttgtacggattgaaataatctggtagaatatagtacaatagactcagtaaatatttattaaaaatgagatattctaatgattcaatatgtccatgtgttttcattaaaaaatttaatactgagtttgttatcattgctgtgtacgtagatgatttaaatatcatcggaactcttgaagaagttcgaaaggctgtaacttatttgaaagaagaatttaaaatgatagaattaaataagataaaatattgtcttggccttcaaatagaatatatatcaagtaaaattttcatacatcaatcagcatatactgaaaaggttctaaagtgcttttacatgaataaagttcacccacttagtttctctatggttgtgagatcacttgatttgaaaaataatccttttcgatctaaaaaagaggaagaagaatttttggatcctgaagtaccgtatctaagtgcaattggagtacttatgtatcttactaattatatccaacctgatattgcctttgcagtaaatttattagcaagatttagttctgctcctactcagagacattggaatggcattaagcatattatgcactatttacaaggtactgttgatatggatttattttactcatataattctgagtgtcaattattaggctatactcatgctgattatttatcagatcctcataacggtaagtcatagattggatatgtttttacttatgctgactgtgccatctcatgaaaatttgtaaaacagacaatggttgcaacttcatctaaccattcaaaaattcttgcactccatgagacaagttatgaatgtgtttggttaagaatcataattcaatatatttgaaaatcatgtagattatcttctataagaaataccacgtcggtaatatatgaagataatgctgcatgtattgcacaagttaaaagaagatttatcaaaggagattgaactaaacatattttactaaagttcttctatacttatgagcttcagaaaaagggtgatattcatgtgcaacaaattcactcttgtaaaaaattagctgacttattcactaaggcactcccaattatgatttttaagaaattaatttataaaattgggatgtgatggcttaaagacttaagttgattatagagctagtttttaggagtactgtactcttttttttttcaccttggttttgtcccattagatttttcaggtaaggttttaacgaggcagtatgtcctaaataattcacaagaatattgtacttttttttcttgactaaatttttttttcatagaattttttttaataagatttttatgaagtacattcttcgtgaatggatcttccaagggggagtgatataaatagtcgttgaagctcatatggataaccctttcgaaattggaatatattataaatagtcgttgaagctcatatggatgagtctttagaaattggaatgagaaatattatccttcagatgagaaatattatttcctatgtaaatgaataaaaaatattattttcttttgtaaatgaacgagaaatattatttttctttgtaatttgaattaaaaatcaataaaagggcttggaatgaaatgagaaggattattaccgtatgaaaagatttcctctctctctcgttctcttattgtgtctctctccttttattatatattttattattctacaatatatttgaatatttaaatgtgtgttcaagcatgtataccacttccaagatccatactttaaaccaataaagtgctcaaagcatataagtaaaattttttatcaccaaaagcatgcctaataagtttttaactaatttaatttaatcagcaatcatagagagataacaaaagtccttgtataattgatagtttcctcgatagggatgtgtatatatggataaccatgaaagtgatcgaaaaaaattgagattataccactctagaaagataataaaaagtttttctaatcattactaaaaattatgattaccatgaaaaaaatataattcccattatggcaaattttaacccaaaaaattaattttagtaaaaaaaactttaccttttttagacatcttaacaataaggttgaaatcaaatcggatacggattagatactagcatatttatatctatatttattttatttgacgaatataaatatggatatggatattattcagatgcaaaatttatatctatatttattttaaataaaaatatatataatttaaaaataaaaaatatggatataattatgggtattatttagacaattaaactttatagctataggattaaagatattactaaatagatgataaattaagttaataatatatttatattataatatattttttaaaaattaataaatactatataaaattatataaaattatatataaatttaaatattcggatgtagatcatgtagttgtctatccatatctatatctattttttttaaaaaatataaatataaattattaaatttatatttatatttaaattaatttaaataaaaaaataaattcagatggattacatcaatttccctttcatccctactaatcatcttagcctttaattatatcacgtgattaaaagaaccaaaaggaatcaaatagagaaaggaaggccagcctccaaccaatgtcctctcatcaatttgacatctttccatcaagagcactgaatacgccgttcaccacctaaaacgtcacctcaaatggacggctgacagatcatcaacgtctctttctagaagggttcgggttgtatctttcgcgtggagggacgattcaccttcttcagcgacatcaaccgttggatggcgcaacagagttgaaacaggttgtttgaactgctttaagctctgtgcgaaacgcaatccaacggtcgacgtcgcgaaagaaggtgaatcgttcttccgcgcgaaagacacaacccgaagctcctttcatttgaggcccggaccgacggccggattccgcagcttaaaaacccaagcgtttcggaagaaggctccgtggatgatttttatttatttttttctctccagaagaactgtagttatatattgtggaggaaagagtggccgaagccctctttcgggtgtttgggtctcgctcccttcttctacccttcgtctctgggcgtaggccaggtgaggcgaagacgaagaagaagagggggagccctcgccgtgtggagctcagctagttgatttcccaatcttttttttttttttttggctggcttcggaaattatcgaattctgcttttatttctcggcgatttcttggtttcgatcgatcgtaggccatggatgagagaatcctgctgggtagttacttccagtactccccttctggagtcccctcgtctccccaccattctatgaggtctcctgcgtcttctgatagagaaaggtccgttccattgcgttttcattctattcttggttttcttgatgtgggtattggagttcttgattagggtttgatagggcatgtgtttttgctgcgtaactctagtgaacgattggtggttttattgggcgggtttgatttctttcctcatgtttgcagaagttgccgttgtttaggttgatctcggaattttgccctttttgttggggtttgattgagtgtataagctgttgaaattttttggggcttagggtttttggtgattagttgttggcttttttgtatgctaattttagggtgccttgaatttatttgcttctgtgtcagttgtttggtgtgtgtgggtgctggcttgcatgtgtatattgacataaataatgtttgtttttatctagtctcatgtgctgaagtctatcaagcaaacaatagactcattcttttacccaaaaaaaagaatagattgattcataatttcatggtgtatctgcctatgtgtgcatgcatttatgattttgtgtgaatacacgcacttaataatgtgagttctaatgtacttctgagtatgcatcataatagtccgcgtagaggatgtgttatcaggtcattctgttcaactgctaccatcttagacattattatttctgatatcaatgaatatttttgaatgtttgaactgttaatgtgtggcctgcatctataattttgtatcagtatgtgttagtgagcaccgctgaacgtcccatggcttttgtattccctctctctctcaatgaatgtcctccactattaaagtacatacatgaacatccaggtttgcaatcacagattagcaaaaattatttttttagtttgtcgaatcctggaaatatgcccctgtttgagtgctatgttgtctgctctgttatcagtactgtgctggtccatttgctgttaggccttgttaagttccactcatctcgagttatttggtctgatgctaacagatatttaactgaactgctggctgagagacagaaattggtagcgtttgctcaagtactgccattttgcagcaggcttttagatcaaggtatgcagttcctttgcttctgcctgttacacgaagtccactagcttaattggtcattatattggctagtggtttcctatgttgttatttggtgaaatggtgggtcaacattgttgcattatgggtcatacttgtcgttattgtgggattccccctttgcttctgcctattactgtgttatatgaagtccactagcttcattgaactttatattggaacatcctttgttcttatttggtgaaatggtgagtcaacattgttgcattgagtatcagtcacacttgtcattattgtgggattctcactaaaatagtatttgtagactttttgtttaaaagtctttgagtttttactgccttgcttatcccatcagtcagataaaacctggtttttggaaaattgcatgtaatatgattttactttgattacttcttcttcgtctacttcatatcatatgccaataaaatattcaactttggatgcaaaaaagattcttattgtctttcatggtttacttggtgatgctctgacatgactttgtttctttttatttattgacatataaacttcaacacagaaattattcgggcatctggtttggcacctaatcaaagatttgttgatcctgagagaattgaacatggcaatccattaagactgactcgccatccttcaaatggtggaccaatggatttggagggctggtcaggaatgcaaacagaggtaaggtactttcactggttacccttgttttggtaattgattttcttcagcaattaaattgacagatatatgttgccttttcgctcttgcttttctctctaaaagagaatctatgttttctatgctgttctatatgttagaaactttagatttttttgtttttaaattaatgtaaaaggttttgtttccattaactttgcttcatcaatattgcttgcagcgaaggcttctgtttgttcaatgaagttttgttattctaaaatttattcattctatctgcccaattacctgatactggtagctatttgtagttgtattgttgctgtatatgctactactgaatatgtggtttcaagaatggtaactgattaagctaattatttgggatgttaggatgtaagacaggcctcaaaggaatgggatctggtatggtttaggattaagctaaaccctacgtattgctggaaacttatgttgaaaactgaactgcactaatgtgagttggatcctaacacaaaattgataatggaggtggttgtggaccaaaagatacgaaacatggtctggttggcactttaagacttaaccctggtgggaatagaggaattttactgcaatttgttacggcaatgaaaacttggggtcaaaatttaaatgggaatctaagttgaactatcttactggggaatgatgaatagcaaagtatttatactggactgaggttggtacagaagtttaaaggagtttatgaaggcttatgctgtcaaacttgtagactatgaatagtataaaaaataacttgaatagaagaaaatactaggacaaaggaaatatagtagatacctatgtttgaaaaatcttaatatagatataacctgaaatggggatgcttggcaaatgaggatccattaagcaaactccagatagctgagacaaggctctatgattatggttatgtaaataaaatttatactagtggcctcatgtcatcatgagctgggggcttcacccctaggttttgaagatctcacaccatgaaacatgtagacactcttcaattgtcaattctccattaactaagcaactggtaatagaagactttgccctattctaaacttgtaaagctggtgtaaagaaaatgacaaagaaagaaaatgaaaagtgaagctattgtagtccccgcattttctaggtgatgagggagaccagctggatccatagtgtgtctggccctctttaactctttactttccttcgcatgaacaactaattcttaagagaggcttacagaggaaattaatacataaatagagagtgaacatggtatgacttcttatttgacaatctaaaatttaaaagcaagggcttcatactgatatgtctccccttccagtatttttgacatctacatctatactatttcaagcaaaaggagaaatttgattttttagagtctttgaccagattcctttggtttttcttcccaaaatatgcttgaccaaaaaagaaaatccctttaaaaattcccaatttttctcaagtctcctctccttaaccagaattagaaaataaaaatgatgcagtgcctaaatacagatgcctaatcaagacccgttaatatctcatcttgccatgaatatagatgtatatccttatgctaaacaaattgggttagcatcttagtatagatatagacacctttcgtatattatgatcaatttcccatcttaaacatggatgattctcctctgttattcttaaatcgggattacaatgatccattaaggtgaaaaaaagtatgctccttttttctatatagatgttcttcttgatttcttccataggtaatgaaagctgcaaagtaaaatgcttttcaacggaaaggagtacatttaacaattcacatacgaaaataattaattgaataaggcctttctaggccttacgcattcttctttgttggcactgcatgctggccagcatgggaccacaactgtgctaatacagcacatgggagcctgacgcatgtgccaattgcgtacatgtcattggttcgggggtgtgcgaggtgacacccacaggcaatagaggatctgcactcactaatgcagcaatgcttgacagattcagtccatttctcattttgcttttatctttaaatatttttgtttattatctgttttaatttatattttaaaattcaattcatctaacagtatttttgtttttatgctatttttttattttgatattccatactgtataatttaattctttcctctgatgtacgctgcatgtgctaatttgttaatccttcccagaataagacttccacttcgtggctatctcctactaagtcattccttctaccttatttttcatgtataaatgcataatcacaagatattcttccctactcatcctcatttgactgtctatttgcttaccagcactggatttggagcccataaaagtgcacatccatcctctctctctctctctctctctctctctctctctaattttaagatccttttggaaggaaaccatggatgggtggttcctcaaaagcaagctttgtatggctggatttttcaataagaactctcaagagactcattcttattactgatcatattggtttattagccaacaagaagatgcaagattgcaatgctaacctcaaagtgaattacaagtgttgaagggaccaatttggtacaaaatgttaacaaaataattcattagttccaacgagcactagagaattcagttcagtccgggtgcaaaccagcctaaatttccccaattttaaaacatctccatctcccatccatggatgtgggacttatatttcagcaccagataatttgtttagcatgcaatgcattgtcaggaacaaaatatggaaaagaatattaaaagatcatagaatcaggacctttctgtagcattgttgctgaaagtgatcgcatataagataataatgagaaataagtggatagggaagtcctcttgtttcatgaccatcaatgacatgaaaagaagagtgttatgttttgggtagcagctgtaacttgaactgcctgactttttactcagccaggttatgttttcaccaccttctccaaaccttgaactaagaccttttctggaaattaacagaatcagggaagagctattgcaaagggtgggttggacagcagtcacagcatgcatgcttcccttagagtggtggcaccctctttcttttcaggatcgctctcttgctacccagtcaattgcataatttagaatatttgcctgatggtacaaatcttagcactgaaaagttgattattccccctgaaggagttcactcattaaagcctccttggacctaaggatgcaatcacaattaaagttgtttttatgatcaatatgaacaatgcaagaaactacatgaaagcttcaaacataattaaagttgctatgcatgtgtgcatgggacagcaaaagaacatttctgaagattttgggactgagaaaaccttaaataaaaggctaaacccttcactgggattctagcctttaactggctataggagttggatctgacatgatttgaaggccatattgtcaggcaaaaactccgtttttaagtctttcatttatctagtcaatgcaagaagtgtatggttactttaggaattagaggacttctatatgtgatttgctatttttgggtccctttcttctttctttcagttgttgactagtagagacccttggacatcccagaataaaggtgtcagtaaaagtgagagctttcctatagagttttaagtagagcaaattatagagaaaatacatgggcagtttgcttctaaaagaagtcatgccaaggcttcaagtaagttgtatggctgatcattaaggatgatttatgcactgattatattttgagagcaagaaaaaagaacttcacgtcaggtttggtccttgctttttcttaactatctttgcaattcttttgcatttcttaatctacattcttactctttcaacctgctatcatatttgctgtacaagaatttatttgccatgcttgtcttactctttcaaaaaaatcaatcttatttgtgggaatttgattccttgataatcttagtgcttaataattaattttggatcttaagtttctttgatattttgttctttctcctcttttcaccaataatttatttccatggatttttacatggttcaagatggaacctattccttaaattctagagcctttataatgtcatttctagtattattcccattatctaagctctaggcaggttagtttgattatccattttgttgcaacatccaaaaattcatatatctggaagctagatagacaaaaaaatcccaaaaccatattaaatctaattctttggacctttaatgcatacacggacctgacattgttcctgtgcctagccagatagtttgcaatcttcatcaagttctcgccataaaacctctgtttgggatggaaccagcccaagtggccacttagctaaatgccctcatgaatttcaccatctcctatcaagtgtttcagagaattccagaagcccaagcctaaatccggaatttagctgagttcctcaaagaaaacctctaaccgaacccaagagaaggtagcatcaaagaacatggcaatggcaaagaatctgatctaaatatagcagttactgtaagccactatcctcaagctgatgattgcataatctctggcaactgcagggcatatagacatcataattatggtgttagggactgtcaacatccatcagcagggatatggagtgacttcaacttgtttcctttttctttttcctgttctttctgtttttttaagcaatgagtttaataacccaaaaaaaaaaagctaaagcaaaaggctgatcaaaattgggacctggtatgagtacaatgaagcaagggaatgaatgataattaagaatccaaagttctgttttgtaattctaggttccaaagttaagcctttcttagctaaggaagagttggtggtgtctttgtttcgatggcccgaggattgaaacttgtcaacgcttaccttagttttctcaatctctctctccttcattcttccttgtctttgtcactcaaagtattcaatactatgtaattttgagtcctgatcttatgtatcatttgaacatcaggtatgaatttacaagccccatgcatgtggtaaagatgtttaaagatgagttataccagcttgtcttcttgatgccatatgcatcttctaatcaattggtcaaaggtgctgatccatttctttcttatttttacccttcctatttttatatggggacgcgtgccttcatgttgaagagggtgaaggagagcaggggggagggtgggaaataatggttttaatgccgatcatttgatgtcttctgcatagccaaaattttgcaccagcagctgcttagataatgcattgtttgacacatgcctaaatgtacagcttgaaacatccccaatgttgaattctggtgctgttaaatgaagacatttttttcttaaatgtccattgtcagcttatttttcccacttggttattgaaaaatacataatactgacctgcctatagctagaagttgattttcatcattctgtgctgatcatgtctaagttgttttatgctaaccctgttcaggacaatgggcattttcaaagaatgggaccccttcaagcatcacctgttggttggaatggagcttctggtgttgctaccagcccaatagttaaaaaagtcattagattagatgttcctattgacaaatttcctaatgtatgttaatcttatctggcttgtgagttgagttcttttgcatttaaatgtcaattaatatatttgcatttttgtgaagcagtacaattttgttggccgtctgctgggaccacgaggaaactccttgaaaagagttgaaaattcaactcattgtagggtttacatacgtgggcggggttcagtaaaagactctgcaaaggtactgtgatgactattatcttatatgtccttaaattttgcctcaactcttcttgagcatcccttagcttgtggaatcattatagtttatgaagttttgactgttgtatgacagtaagttaacatgatttctatggtctgacctaattctacaacaaagtgatgcttttgttgctatttacaggatcgtagtgtaccgactgcctgaacatagagggtacaacatttgtaggcacatatgcaatttatgaattttttagggtattcacttttctttaaaggattgtttagatcaaaagactagaacttgctgttttttaaagtatctgatacttccccaaaattggtcaattcttttttgcaaaataatcagccacttgtctcagtcatgaaatctgtggtaaaaatacctatttgaagcagtgctttcagtatttctcctatttgcatagattaatggcatgcctttctttaagctaaggttttacatttctatatattacctcataatgatttagtttccttgttgtttgattttgtaagttaataaaatgctatactttatatatcagctgaatcattcttgtgatgattgaaattttagtgctacttgctgatcatcagattcttgacttcatgtgaaagaagaaatcaaaggcagggataactgttattttactatgagagggcaatgtaacatccaaaaatatggactgtcatcattacaatcatttactggctaagataatctgatgcatgtaaaatcatttaatatcattataaacaaaccacatagacatatacagtattgattactcagaaatatgatcaaaaccaaatgttgtatttgtggggttagattaaagtataaacccttttttcaagttaaaaaaaaaaaaaaaaaaaaacaaaaaccaatgttgactacccatgtatacttgaagaaatgaagaaatattccaaaagaacacgggaaagccaaataatccatgtttatgggatcttcaatgcaatcaatttcagctgaaacgggctgaaatgactgagacaggacttaagctagtcaattttactgaaattgactggaattactgaaataatcaaagcttaaaaccttggattaaattctccatcaattagttaatagtcatattttattaacacaggtgccttgagctttcccctcaggtttagagatccggttgacccatttggtcaatctgtcacctattagatattgcaggtcagatcaaggtaaaagctggagtgagattttgaaccattaacctgggtggttcaactacttgaaccacctacaccaaataaaacaaacttgagtgctgactgatgaggaagaaaaggggaaacccctaccccccccctaccaaaaaaaaaaaagatttttcatctcttcttagttataactcaaggttttaaatctcatgggtcagaggtgtcccaatatgtctatggaataggacaccccaccatcccatcccaacaatcatctagtcatgcatcttggtagatatcctccgtgtctctccccttctttccttcctttctttttcttttttcttctaccttattttcttttcattccttttttcctttttcttgtccttccgttctttcttttttccttttcttcttctttctctttcctttcttccttcttttcttccattcttttcttatcccttcatttcttttttttatttttcttctttttcttctttttcttttctttcacttttttctttcttcatctttctttctttccttcctctttctttttttctccccgcatgtatggatttcggagtctcgacctcatcccaatctcattttctcacaagaataggtttgcatgcctcctatctagttgggatataaaaccttgccataaatttgcctagcccttttcttggccatcactcttaggggtagcaattgggtcaggttgggttagagccgggtctgatcaaaaaagtccaaacctaaatctgaccaatttattaaataggtcagattttgaaatctgaacatgtcttgtttaatatataggaaacccgatgatccgatctatttaacctatttaaaaattaggtaacccttttacccaatctgacccagctgtttaacttctagttatcggatctaaaccctatctttaattcttacaattagatgaattcaatgaagggaatgaaactaaccagagaatcagggaatcaaagggcagctgcagctagacactaatcgagggcaacagcactatcgtcccacattctcaggcactcccagtggagatcgatgtgggggagggagcagaagagggggaggcgggggtagggctcgacagtgatcgagaagagatgataggtggtgccatctcgaatgatggtcgcaaggatgccgttcatattggcatggacgaagaggaggaagttgccatactggcataggtcgacaagcatgaggctggtgatggcctattggtgccactcgcggagcttcgtccactccatctccttctggctagtgatctaaggagactagagaagggaggggaggaagagagggccgaaccatggaggagaggaggtgaggggagaatggggagggaggagtctactggctttttttttggcccattgaaagagagagagagagaagggattatgtgggtcaatgggtgtggttgcaacgcgcagcacacgtatttttttattttagaagacaggggtcatatggatgtgaccacagagcacagcgtgcatatttttctgtttgcaagacatgctcatgtcaattcaaattttaaatagacgaacaacggacttagacagtgttagactttatcatttattttaaatgagacgggcattaagtggatacccaatccgactcgacctgtttaataaatgggttaaatatgtcagaaggtcagaacttgaacccgacctgtataatcaaataggttaaacggatcgacctatttatgacctgaatccgcctaagccaaacccaaacctgtttaaggcgggtcaaatatgggttaggttgatgggtctggtcatattttttcaaccctaatcgctgttgttatggtcaatgcagggagaaaccttgctgttgaagtgatttttttttttcctttggggggaggggctatggtggtggtgaacggtaagggtgcttgagcaatcaatccaagaaaaggggaagatgtcttgtcaagcactggctatggggccagcttaggggggatcaaaaggtgagaggaagatggctacagctagagaagggttggagatcaacacattggagaggtctagagcttggagacattggagaaggagagaatgtgaatagacacagtaaacaatgaagaagcagggatatgagaaccatacaaggacttgagggatttatctttggcctggtcagactcacagtcaacctgcagttgaaccatgagctggtcactcggccaacaatgtggtttgaactaggtcaatggtacaagacactgcttcctcttgattctccttgttcctccaattttttcattatcattccaccttgttccattgaaggattttaaaaaaaatcaagaagcctctaacgtgaatttgagcccaaaaacccatagatgtggcaaacaattcctatatatattttttttggtgagaacaaatgtttatttatttttagtacgttgagttactttataaggaaagttaaatattaaactgcaaaacaagagaagttttcaaagtggatatgtcaacatagagtagacaatcatgcattattttatgaacagatgaatatgtcatgggttttacgtctgcttttcagtcgagacattttggagttgcagaaccttattagttagaagatgagctccattctgccatgattacctactaaaggccattcccttgtcatatcaaatatgtctaacatctctctcatccactgcttaaagcccaaaaccatcatcacggcacaaagtacaaaccattaaaatcagctttacattatttcactatattctctacctgcattctttatcagctacattcattgtatactctttttgccaaattttttctgtcatctatttgaatttctatgcttttcctatcttatgtaagtgctattttcaagatttccatttgaattggttaattatacagagcattccacatgactataaattgttcctgagtgtttttggatccgatgattatgtattcatacttcattatgactttttcattgtcctgtatcataaaagtttgaatacaaaagaaataactgttcagggttgtcattatgctgcatgactagtcatagttgatttttttggtcattatgctacatgtctcctgcaaattggtttattgctcactggttatattaagatatattacttagtgctaagaaatattagcacacagtactgccatttgtttgccatgttcagaggctccggtttcaaatctttctcaaagatagatgattgtgggtcttgagaggacctatttgattcttaattatgatcgttggaatgaagaggctttgaggaccttccttctaaggagaaagcacgaattttcttgtccatttccatgatagaaatgtctccctttgaaacttcctctcctctcacccggaagcttgtagatgcactttttcagtcacatggtccatgtgttgcagttgtatatcacttgttacaaagtgggtcgcggttctaagtctaggccattgtacttttagtcttttactaacacactgcttttgcttttttcatgctccaagtattgacaaactcgatcagtgacaatcaaggtgcttacaattataggcatcttatgctgttcttgaggtcagtgacaattgaggaaagctttgaccaaaatggattagtttctacccgaaatgatcctaaattggcagatttttttgtaagcacttaaactgattatgtgctagtattcttcataatatagatatttaatatcattttaagaccaccatttcgtacattttaaacttggtgtgattttaggtaattttccaattttcttaaataaatctgattagatagtgtcaattttagtatatttatggatgatagacctaacatatgagaaacaagtacttcattaacattaaccatatatctttggaatgtttaaaaaaagatttgggatttttggcaccaaaatgatcaagaaataggcagcttttctttgctttaacaaaatcattcaggtcttgaagatatatatatatttttttttctgaagaaaaatatgaggaaaaggttctatgcataatatttaagtttagtgtgctaatgataggaaattaaggtttattttccatgccttgaatctgttaagtaagctttgtagtgctttgtaatctctttgttgttagccaaggagcagcttggggttgtttttgctaggttttactcaataaattggattggcctctgcccaattcttttctcaaaaaaagaaaaaaaagggttttctagttcttagcttaaattcttaagacatttagttgagatatgtcaaattatagccttttcggaattcttagtagattataagtcttatgttggtatttgttactcaagatgatgttagttattatatgaagttccatgttgatatgaagttgtatgttcttgtcatggcctaattgaggtcctggagtccttgttgatgaaaaaattttaggtccagtagtcatcaccaagaatgtatggactttggagtatggtgttttttgttatctcctatctaagtctttgaaaactataatattagatagggttcattccatggttttatgtcctaacgggacgagagcatcccggccgtctcggtcgtcgcatcccgtttctatgagaaaataaaattgggatgggcttaggactccgaaacatatccatatagggagagaagaagaaagaagaaagaagaaagagggaaaggaaggaaagatgaataaaagagaaaaatgaaaagaaaaattaaaaaaacaggacagaagaagaaaaagaaagaagaaggaaaggaaataaaggaagatagaggagaagaaagaaaagaatgaagaaagaaaaaaaaggataaaaagagagaaaggatagaagaaggggagaaagatggaggatatccatgagatgcatggctgggattgttgtcgggacgaaatgggacagctgagcctctcgttccatggagaaatcgaaatacctttgttccgggggattaaaaactttggttcattccttccatatcaggacttataatttctgatttaattaatgatgaagcctaattcctttgtttttttcattatgtgctgtgctgagcagttaaagagaactgctctgatatgtgggcttgtctacctgtgggctgtattggatgggctacttttctatactgttctttccttggattcatatgagatgcattaatgttatcagtggtgttttatgatagtgcactctatgtcaaccttgaacagttggagcaggactcatgcaaacttaggaacagcgttgacattatgtaattaaacttagcaattatgcatttgctgttctttatgctaaaatctattatttttatttacaaaactatcaatttggggcagaatctcgactgcttatttctatctcgacctgcaatttcatttttctataggaagaaaaactaagagataagcctggatacgaacacttaaatgagccattacatgtgcttgtggaggctgagtttccagcggacataattaatgcacgattaaaccaagcggtggcaatacttgaagatcttttgaagccagtggtacatatcaatgcacctctctctctctctctctctctctctcactcatgctaggttacttattgtggttcttgtttctaggatgaatnnnnnnnnnnnnnnnnnnnnnnnnnnnnnnnnnnnnnnnnnnnnnnnnnnnnnnnnnnnnnnnnnntcgacctcctctctctctctctctctctctctcactcatgctaggttacttattgtggtcttgtttcaggatgaatctatggactactacaagaagcaacagttaagagaattggccatactgaatggtactttaagagatgagagccctcatatgagccccagcgcatcccctttcaacagcacaggaatgaaacgggctaaaacaggacgttgattcaagaatcgggtggtggatatatttcaaacgtgacaactaaagttgggttccattaccttatgggtgatttaagattttggtggtggatacaattcaaacttaacaactaatgttgcgtttcattaccttctgagatgatgctattttcagatactcatggcattcaaattcttcgcaatggaatcatcggaagggccctggacaccttaatatgttttctcgtggtagatagatcaagtgcttatattctttgatatagacatgtttgtgtggcagttccttaatgtttcattcgtgaacattgctataaagtttccataatattcgttctgtatttttttattgaatggtggcattaatgtgggattacctcattatgtgctcccatgatagaattttaaacaatataagtgtttttgttattattgatgttctgtatcctcacctatttaaatttatgacagatcaaattattatctaatatgcataatatgtgtataacttgccagtcgtttttgtagaaccttttgcagatccacgcagagccaatcatatcctacctatgcacgttcattttggttcgttttactgtgccttttaggggagcttatgatattaattgtagaaatttggctgcaggcatctatttctacaggtatatgactgcgtgttaatctaactttgttgtgccaaatcagctttagagatgttctttatttctgacaggaagtcttttttttcacttgtcttgtaatcctgtatgtattttagtaaacatagtgtgagtttgtacaaaaattattttaaattgctttgaagcttgattggcatgatgaatgtactgttattccctgcaactgcaagggctagagcttaataaaactagaacctcatatgaaataattgctcagttaatgtgagatttcttttatagtttcttttcccccaaaaaagtatagcttgagacagctgctgttgcagttctttgtcatctcaatcacttctcacgggagagctttatgaggagctgtagtttctggcatacgaagaactgtagatccttttggagtctgattttgtggacggctttgacatggctctttcctgtgcaagtcacggtggctcgatttgtcaaacaaatcttagatgtatgggggcttttgttgcaggtcaaaatcaagaagcttgccacagtcaagttcccaatgcgattattagggaaagaatttagctaatctcaacggattccccctctatggaatctgaggatggtaaacctacagaattaggatcaacaactaattatgcccttaggcagcacatggtacaagggagtaacgggaatccaatggaggttcttccaggctctcgagaggtgagaccccaaaccattcctctcctctcgtctctggagattctctctctccatcttttcttactgcatagtctttaattacaaatattttttaaattagtttttgattaaaaattctctattacctagtaagggtgtcaagtttgagggtatctgccgtcttgaaatatctctgaagaggaagaacctgtcaggtgacaatgggaggcacaccgaaggcttaaaatgcttcaaggctttccgtgtttatacggagactaaacaattggcacgctggattgtaggtctctagattgaaggagacatcatctgtgcttcaacattttaagaagctatgtaggtttttggttgagatagattttaaaaagatggcttagtgcacaaggttctgaccattgcagagtttggaatgaattattggtatgcaatcttaaccccgcatgcagagtgtttcaaacccatgatatagactaatcttacaattgcaccgatgctcaaccaaggcaaagataggttttcaaggatacatttacatgatacaagaaactatagcctttttgtctaataaaggggaaaagaacaaaaaagaaaaaaaaagaggcagaagagtcgtggttgtcgtgccaaagaccaagtccacgagtacttccatggtgtgtcattttccatggacctttttatttggacactgaccaaaataaatttaaaaaaaaaagattgcaaaagagactgctgtaccgtacatccgccttggccgtctctctcatccactgcttaaagcccaaaaccatcatcacggcacaaagtacaaaccattaaaatcagctttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatatatatatatatatatatatatatatagagagagagagagagagagagagaatcaaatccttttcatccaacattaggccaattcaattgatgcttcacataagcaaatgatgatcgggacatggggtgcacattcatgttcagcataacagacatttgtgtttctgttgtcctttcttacaccgggaaacatgatgggatattttgaagaagttcttgttacataaagaatgacataatggaaaccgcaaagaaaacgaaaacgacaatgacaattgcttacaagaaaaattgatgtgctctatagtttaaaactcaagcctggtgcatctcttttatccaggtatttctggcgtattgtttagagccgtaacaagaaatcactggcactgccaagggaattaaaaacctctcgtaattcctgatctcttgcatgtcctgtatacatgtggcaacatcttaggcatataattataggcatattttgaaacaaaataccccgttgcttttttcttatttaataaggaaaaaaatgggagtaaaccatccttattcatcccaaagagaaatgaaaagaacaaggtattagaaaaaaaggcggacttcccaaacgagaggcttcgtcaagaatagatcagcggtctgaccaatcctagaaagatattgtcactcaagtaatgtttggcttgttgttgttgcggccaattccctcgttgcctgatcatcgggaaataagcgcctgtaaaagaagtccacactgaccggagatacctccggcagggatcctccgacggtcaagtcagagaggagactaggcaacagtagaaaaaaatcaggagagctcagcgatagagagagagagagaactagagagggagagtttaggggcttcgaaagaacctcctccggcactgttgccttccccgttttatagtagagcacagcatggcgccgtcattaatggcgcagacaatggagagttgtcaaatcgtcggagactgtcagagccgtcgtgggactgtcaaatcatcgtggggctgtcaaatcactagggttgacccatgtctagggtagaacgatgtctcagggcggctatgccgcacgcctctgtcaggacgggcggccttcagcagtcgtacggaatctggaggagccgaccgaccatacgtcggtatttggtcgtaggatgtcgggtaggtacaccgtcggctggcgcggcgcatcgcggggatcggacatcggccaccacctccgatggtcagtctgatacgttgccaaggttgggggtcggaccgtgtcgttcggccagtcgggaacgggaagggtcttcccgaccgacataccttcggtcgaacggtgtcggtcggtgtggtcggtagagtcaggtgttggttaggcgggtttgatggtgagtcggtgcgagagcgaccggtcggtatatcccaacagttgcccctccactcctgagtcggatggcgtgatggcccgcgcccttgcatgggcggcggcgtcgggcgaaagaagttgatatccattgcattatgttccgactctagcgaccgtaccaacattcggtccggtgtcagacatcttatcggtatcaggcgactcatcggtgtcaaacgtcccatcggtgtcaggcatcctatcgggaatagaaaccaccattttcgccgtctcttcgggaacgcaaaccgccacgacttttccgccgcgtggcgggggggccattggaccgaacccgctcaggcggattgagtcgacgtggccgaatctggggcaggtgcgtcgaaccgtcgagccgaaggaaggcccagatgccgccacgtgtcacgatctgggagatcctcactggtcgtgctttcatctcgaccgtcagggggcactatatatacggggtcacctgtatccggatttttacttttcaaactttctgtcgagaccctggttgagcggtcccccttgtctcaggtaatcgtccccgtttcctcccttagaaagtctttttccctaggagccttcatcgttgtcctttgttttctccttgtttccttgtaatcttctttcttcttcctctcattccttgactttggttctagcgtaatggctagaacatctccacggggaggtcgatcggggaacccgactgacgattcccgatcgaccccggaggtgaaggtcttttcactttcggggccgaatgttgatcggctccgggagcagtactgcatcccggagcagtttcagctattcgcccctggagccgatggtcgggttaacaacccgcctgcgggccaggtggccttctacatcgaggaccttcgggtcggtcttcgcttttcggtttcggagtttgtccggaacgtgctggattactacgagctgtgtccgatgcaacttgcaccgaattcggtccgactagtagttagatttgccctgttgtgtcggcttttgctgaccaatcctcgcctttcactcttccgagttttctttgttctccgaccccaccctaaagcccgagggtggtggtatttcaaccctcggaagggtctctcctttatcactggtcttccatcgtcgattcatggatggaagaaccagttcttctttgtctcttcttccgttccttaggagttcccttcctgttggggagacccccgaacccaaccaaacgagaacagtcgggtggaggccggggaccgaaaagacttccaccgtctgaaggacatctcggtgccgaagcagaaggagctcatcaccgaacaggccctgtatgacgttggtcttagctcggttcctcgcctaggtctggcttttttttttgatgctgatcctctattgtcgttgcagatatgccaccacggacgaggttaacggcagtcaatattcaacagcatgcggcacgaaagaggccggtgcatggagccgaaccatcacggcctcccaagaggccccaagtagcaccgacggtgggagcggagtttgtttccgaatgggcgtcggaccgagagccgatcatcgcactgtcggtgccgacagtgcccactgaagtcccgtccgaggaaccatcgatcgagggagcagcctcgcccgagggatgggcggccgaggaatcgatcgaggatgtgccgaccgctcagccggcagaggaggttcgggaagaggcgcgcgagcctgaacaacctgcgtcggcggctgccgcaccttcgggagggacccagtcaggctcgagcatgccctccctttccgacgtcagggcctgggtgtccgcacgagggaaggccccgatggcacccgatgacgataggaggtcggtcggtggcggagcgtcgaccgattacccgtttcccgaaggggcgtcagccctggccctccttttacccgaccatgattcgagtaagtctcttccctttacttttcgttctcatcgttgcctttcataagttcgatcttctgacggtcggctttgttgtccatagctgatttacaatatgtctgaattggaggtcgggtatcgaagattcgacgatctccgggcagcctggaaagacaaggccatagccgccgaagccgacaaggcggtgttggtcgaccagctgcagcagtcggtcgattgggaggcccggcttgagggggagatctcccgcctctccgtggaggtctcccaactcaccggtgctctggctgcttcggggatcgagctgcagtcgacccgagatgacgccaagtggaagtctcgcactgttcgtcggctgcgatgcgagcgggatgacttcgccaaggaactcaaggccgaacgcgatcagctccgaacgagtttagaaaatctcgtcaaggccgaagagaacctatccaccgctcaagctgacgcagacatagcaagggcggaggcggagtcggcgaaagaagccatgggtcgggccgtggaggacttccgtgactctgaggaataccgggaagaacttctagagagcggcttcttctcgtaccgtgtggggtacgaggacgctcggaaagccgtctgcagcctgtatccggagctcgacctcggtagcatcatcccgccaaagtcggaggcccaagctgagggagagatggctgacccatcatcgggagatcgcaccatcgtggtggagaccgacgcagaccaggctgccgaaggccaggcggctccgacccctgaagcggctccgacccctgaagccaccccgacccgagcggatgcgtcgatcgcccccgatcttctcccgatggaagaagccgactccgatgattagtcggagttttatttttgtttgacgtacttgtagtcgggcttcgacccattttgtaatctcaatttgtaatcgggcttcgacccattttgtaatctcaatttcaagtctgaatgaaattgaaaacatattttcttaactttctctcttacttgaattgctttgtgtgtttgggatgtatgtttcaccgaaacacctttgaacgtataagtcgtaggcccgacgcactaggtaggatcccagatagctagccggggtagtcggtagtgcacgcgccacttgaaggtagagcaaaccctaattttcgatcggcttcccgactgtcgtataacccaatggtcgagagttcaattcgagcgcccgttgcccaggcctgagtcgggcatattcgtcgagtcgggcgtagctctttgagccgatcgtgttgtagggcccgatagttaaacaatgactgacgcgtttagtagatgacaagtcggtcatctgttgcctgattctctgtcaggcgtatgcatcgagatgtgtggtaaatggtggtaagccgaatacccttcgaccggccgtgacctggtcggtgggttgcgaacgcgacattagtcacgttggccttttgcctttcttggccggagccaagctggcaagttagccagtcgccttgctcgggtgctggctgaggaaggggtgcggcttagacttaggggagactccatcgccatcgccaaccttccaccaaagtagatacgtcggtcgccgtaagagttcgacgcgccgtcggcggtcggccgcagatttttagtagaatgctgggcccaagtcgcggcatcgaggttcggactactagcgagcgccgacacaccattggagagccgagattgtagactctgaagttttgaagcgaggtttgtattctgatcaagggtacatagaatttactggtagtacaaccttagattgttggcattccaagttcggagaatggcgcttccttctagagtctccagtcggtaagctctcggcccataggtgtctgctatcttgtagggtccttctcagttcggagccaacttttcctggtctagaggctttgaaacttttgcttttcttaagaccaggtctccaggcctgaaaagcttcggcttaaccttgttgttgtagtatcgggccactctctgtcggtaggaagccatgcggagttgagcctcgtaccggagttcgggtaggaggtccaagttggccctccgacattcggagttgcccggctcttggtactggtcgaccctagttgatggtagcccgatctcgagcaggatcatcgcctccgtcccataagccaagctgaaaggagattcctcagtcgggacacggggtgtcgttcggtacgcccataggacggaatttaattcttcgacccagaggcctttggcttcattcagtcggatctttagcccatgcagaatggtccggttggtcacctagacctcaccgttggaccgtgggtgcccgaccgagatcagtcggtgtgtgatatggaatctcgcatagaactcccagaagtcccggttgtcgaattgttgtccattgtcggtgatgatggtatgtggtagtccaaacctgaagatgatagacttctggatgaagtcttccatttttcgctcagtgatctgcgccagaggttcggcttccacccatttagtgaagtagtcaattgcgacgactatgaactttctttggtcggatgccggagggaaaggaccgagtatgtcgatcccccactgggcgaagggccatggggcaacaataggagtgatttggttggccggtcggtgttgcaggttagcgtatctttgacatggctcgcacctccgaaccaactcggccacatcccttctcatggtgggtcagtagtaaccctaccataggactttgtaggccaaggatttgccccccaagtgattttcgcagatcccttcatgcacttctctgagcacgtagtccgcatcggtcggtcccaagcatctgagcaaggagagagagaacgaccttttgtagagtcggccatccattatcacgtattgggaggccacccatcggagccgtttggcttccatggggtcttcagggctgattccgtcggtcagataccagacgatcggatccatccagcttggttctgctgctaattgcagcaccttctcagccctgttgatgctcggctactcaagactctccaccaatgtccgacccaaggcgtcgtaggctgatgtcgcaagcctggagagtgcatcggcccgagcattctccgtcctgagaatgtgagagatctcgaaatacttgaggtgtgtcacgagatctctcaccctctggagatattttgccatggtcgggtctcgcgcctcaaagtcacctttaacttgccctacgatcagctgggagtcggagaagattctgaggctgtcgatcccaagctccttcgctatcctcaagccagtgaggagtgccttatactcggcttgattgttggaggttttaaagtcgaatcagagggcgtactcgatgaccactccctccgagttggttagcaggaacccagccccgctccctcgagcgttggaagctccgtcgatgtgcagcacccaagtagacctggggtcaggttcggggattgcaacttctctggggctctcgcctcccgatccctgatcgatcgtcgggcactctgcgataaagtcggccaggacctaggctttcaaggctgaccgtggccgatactgaatgtcgaactcactgagcttcattgcccatttcgccagtcgtcctcatgtgtcggggcggtgcaatatcgccctcaggggttggtcggtgaggaccacgatagcgtgtgcttgaaaatacagacggagtcgttgtgcagacatgatcagggcgaatatcatcttctccatctttgagtaccgaacttcagcttcgtggagcactttactgatgtagtatatgggttgatggattcagctcttattctcccagatgagcaccgagctaaccacctcaggggaagtggccaaatagaggtacagcatctctctgacttctggcttcacaagcagtggcagggaggccaggtaccttttcagatcctcaaaggcccaccgacactcatccgaccaagagaagtccttcacctgcctcaggattttgaagaatggaaggcatctctcagctgaccgagagatgaatcggctgagtgcgatgatccttccgttcagctgctggacctccttcttggtgtccgggtgccgcatgtcattgttgtgatccaagtgctgtgcccaaagcctaggggaccaaggctaaggccaaggtccatcattcatgagggcttcatggaggctttagggctagttgggccctaggttgaaaggctgtgggcctttcgggttcttgaggtctaggttatgtgggcctcaagagaccaactctttatggatcaggtctggacccaggataggtgagattaggtcgagtcatgggtgtacatgggcttgggttaacctaatctcccatagagttggtcaagggagttttgggtttgggtcacttgaccctgtgtttatatatacatatactgtataggtttgattaagccaaagaatacgaaactctttctcccaagtctctctctctctctcttctccctctctctccagctattctccatgccccaggagcaagaaatcctagggtttcttgctgccgggtcccaaaaaggcaggaaacaaggggaggcactacctcctccccttttgtgccaccaaccatttcctctctccctctcttgcagccacccaaacatcaggtccaagacttgaaatctcttgcgaagaggttggtacaagtttttctcagatctggagttgatctgaggtcgtttgaggcacgggtgagatctccatcaacagatctacaagaaagactacagcaggacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctgcacctaaggtccgtgggaggagccgagatcatgcttcaacatgtcgatgattgcctttattttctcagagttagcctcaattcctcgttgagaaacgaggaacctgaggaacttccccgaagtcaccccgaaggtgcacttagtcggattcagcctcatctggtgttgtcgtagagtacgaaaagtttcttcaagatctcaaacatgatctgtagtctacgcactctttaccagcatattgtccacgtacacctccatgttgcgcccgatttggtctttgaagtccttattgatgagtcgctggtaagtggctccggcgttcttcagtccgaagggcataactcagaaatagtaaaggcccttgacggtcacgaaggctgtgtgctcctcatcttcggacgccatctggatctgattgtatccggcaaaagcgtccatgaagctgagcagtcgatggccggacgtcgcgtctaccagctgatcgatctttgaaagtgggaagctgtctttcgggcaggcgcgatttaggtcggtatagtcgatgcagatcctccatctcccgttggcttttttcaccatgacaatattggcgagccaatcggggtacgtcatttctctgatgaagcctgcctcgagtagcttgtccatttcctcgtcgatggccttctgtctctcgggagcaaaagatcgcttcttctgcctcaccggcctcattgctgggtcgatgttgagtcggtgagtcatcatctccggggggatgccggatatatccgctgctgaccaggcgaatacgtcggcattggccttcagcagctccactagctgtcgttgctcggggtcgggtaattgagatccgacccagaccactcgttcgggattctcctttatcaggacgggaataagctgttcggccggttcgccccattcttcctctccccgctggttcaacttgtcggctgttagggagtcctttgcttcgttacttcgagcagagatctggaagcatcggtgagcgagctgttggtccccgcatatctccccgactccatttttgatcgagaatcggaccaacaagtggtacgttgagactattgctctaagggcgtttagtccggaccttccaagtatggcgttgtaggccgaagatactcggatgactgcaaaagttaggtggatggtgcattatcgtggttcggttccagtcatcacgggaagagtaacttctccttccaccgtgacggcttccccggcgaaacccaccaggggcgcggagactctttcaagccgatcagccgacagtcgcattcgggagaaagtcgagtagaacaaaatattagtgaaacttccattatcaacaaagattcttcttacatcataatttgctatcgttgccgaaacaacaacagcgtcgtcgtggggagtttggattctccgagcatcttcatccgtgaaggtaattgcattgtcttggcgtagcttcttcgtcggctcccctccagcagtcatccccaggtccaatcgtttggagatcatgttgatgaccccggccatgggctgattgttcgtcgcctccttagttggttggggtcgtcggtcggggatgggtcgagtcggcgggttcctacagaatttttcgaggtacccttattgtatgagggcctcgatctcatccttgagctggatgcactgttcggtattgtggccgtggccccgatgaaatcgacagtacttccaccggtcgaggccctttgcctttaaaggcggaggccgtcgcaaatattctttcccttcgatttccattaagatctgcgcacgaggagcagagaggggagtataagagtcatacctgggacgcatcagcttcggacttcgccgtcgaggcgacctcgagctccatcgctggggtgagacatgtctgttggtcgggggcccgctaggctcgacgggggcccgacctttccttcgcttctccttcgggcccttggcttcggtcaggcatcggtcggaagctccttcgtctgcgcgcatatatttatacgcgcgctccagtagttcggcgtatgtccgggggaggatcttatccaaggagtatgtaaatcgagacccccttagccccctcttcaaggctgaaatagcaatgtcttcgttgaggtcccgaacctcaagcgtggccgcgttgaatcgcatcacgaagtgccggagcatctcattttctccctgtttaggagaaaaaagactgtccgaggttcgtggcggcttccggctgatgctgaaatgggccacgaaagagtgctcaagctgtccaaaggagtgaatacttcctgagcggaggccgaagtaccaggctctggcagctttgcaaagtatggcggggaagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaaagaatcaggagagatcagcgatagagagagagagagagctagagagggagagttcagaggcttcgaaagaacctcctccggcaatgttgccttccccgttttatagtagagcgcagcatggcgccgtcattaatagcgcagacaatggagagttgtcaaatcgccggaggctgtcagagccgtcgtggggctgtcaaatcactagggttgacccatgtccagggtaggacgatgtcccaaggcggctatgccgcacgcctctgtcaggacgggcgtccttcagcagtcatacggcgtctagagaagccgaccgaccatacatcggcatttggtcataggatgtcgggtaggtacaccgtcggctggcgcggcgcattgcggggatcggacatcggccaccacccccgatggtcagtctgatacgttgccaagatcggaggtcgggccgtgtcgttcggccagtcgggaacgggaagggtcttcccgaccgacataccttcggtcggacggtgtcggtcggtgcggtcggtagagtcgggcgccggttaggtgggcctaacggtgagtcggcgcgagagcgaccggtcggtatatcccaatagttgtgtctccccaaggttctcgtcttgttctagattcatgaaatcaccgtttaattggaagactgttcaattgcatgctctcatgggcctgagttctccacttcgggtccgacaacaatattgtgccatctacaacagcaacggctacttggcaaagagattcaaagttcaaaacagtatcgagtcctctatatcaaaccgaccagatgttctcagtcaaaacaaacatcggaattgcacccccttccttgttgcttttccacgtgtcttggtcggaaggcaccacaatactgcgaacctcggcaacctaaagtggtaccaccacgagcctgcaattctgcaatgcgtaggcaatccactttcgtagctttgtggaaaggtggatgagttcagaggaagaaagtaccatcaatatctaggctctgattggtgcactgctgctagttctccaagaacagcatttccatcaggctctagtgccatctttagacttgtagcttattccaccaaggtctgatttcatacaccaaaaccattataagtatcttatttagatgtttcagtgaagtctgtaatttagaataattaagtctaatcctccatgactcatctatcttgtagccaatcatgctgtttggtcggccatcatcatatttcttgcttcaattcagatatccgaatggcctcctataaacctgtggagttcacgcgtatttatccaacttttttaaagaaagaggagtagcccactttctttgagcatgatgacaattgagggggagatggcatttgaaaatggaaaccagctgcagcacccccacttccattgacttgcgccacacacaatcaatccaattcttttttagtaaagttcttcacctaaaatcctttttagcttttatataatctagagttgcccattaggcgtttggtgacgttgttggtggtcattaccgtcctttagtgcattaaaaacgccttgtttctggaccagatcacgatcaaacacgtggtggagacaatgaagtgcgcatgcacataggcttctagtatcaccttacatgcaagtgtgtgcaaaagtttgatcattttctagttggatgacaattcatgcagctctagggacccttttgacttccgttggaagatcattatcttaattcctggtggcattaagctctagtggttatataaattgcctcttttcatcagaagaatattctagtcctagtgcaatcgtaatgcaattatctatctatctatatatatatatacccacctccctctccggtcattgcaatcgcaatcgttcttcaagttcctctggagtactcttgaactctttctattttttttgtctccatctcattgtctcggactcctaaacaagctaagatagtattgcatcatttttgccaccttccacttttctacatcatttgtagaattcaaaatattgaggatgattgcttcttatgtggtgaagctgttaatgttaattgaggtcctaatgagtggagctaggcttcatgtcgatgctctatccatgggttattatgatatgagctgtcctatcgcagagccgattgttagggatgttgtggatcaagctctgcgtcaggatcctactctggctgcaggactactgagaatgcacttccatgactgtttcatccaggtttgttttattctatctagtttctcctgtgctgctacttattttctttgaacatgtatgcttcttggacatccattacgttaattctgaggtcataattcacccaactcaggagacctgccaaaaaaaaaaaaaaactaatatattgcataataaattgaattcataattcactaatggataacaatccaccttgtcaacctgcttccagaaacaaacactacatagaaagatttaatgagtaggaaaaattggaacagtctgaattcacaatttgaaaataggccagtgatcatgagatttccagtggatattgtttacttgaactgtttgttctaaatatttctcttcatctggatgcagggatgtgatggatcagttcttattgattctacaagggatagcacagcagagaaggactctcctgcaaacctaagtttacgtggctacgagatcatcgatcaagccaagcaaatgattgaggatcaatgccctggagttgtttcatgtgctgatatcctcgcacttgcagctagagatgcagttttttttgtatgacaaatatttcttctgccttctgtaatttttttttttttttttttgttgggtactaatctgtttgtttttaaccttttatctttgatatcattgttgatttctagtctggaggtcccttttatgatataccccaaggaagaatggatgggagcaggtccaaaatagaggacaccatcaacttgccggcaccaaccttaaacaccacagctcttatcaagatgtttggtcagcatggatttaacattgaggagcttgtggtcttatctggtatatattatatattttttgactgttcaattacatcattagtagggaaaccaaattgcatatggactgaataaaaggtcaaaatcttttaggaggaaatgaaacaaagaaaattctttaattgcctagtatgtaccttaaataagaaattcagtctcttaagataactgctgacataatttgccatttgaaacccctcaaatctttaaatgcactgcaaattcatgatatttttattaatttaaatagtttttccaaatagcaaaaaattaattaaaatttgtgtttggattggtggccttgagagttggatattagccatcataagttcatggaaatggtattttatactttggtgaaactttgtgatcttttcctctccttatatttttcattttagattcccttaaaacatcaatctgttcctagagagttctatttttgcatacaaaagaactatatacaataaaaactaaatgaatactaaaagatgcctcatttttttgaagtacttaaaacataaaatcagatctagactcctgctaggggttaaatcatcaccatcataagatgatacagtacaccatagccactttcagaattctcttatagtttggcttttgtattaggctatggtagtcactactggaccattcaggagaaggcatgcatacctgttgtctttatattgataataacttcagtcattgcctgcctctgttgttgtaggggctcacactctgggtgcagcaaggtgctcatcattcaagcaccggctgagcaacttcgactcaactcatgatgttgatccaaacttagattcaaatttcgcaaagtcgatgtcaagaacatgcagccaaggagacaatacaccgatgcctctcgatccaacaaggaactcattcgacaatgcctatttcaatgcactgcaaaggagaatgggactgctgttctctgatcagtccttgtttgcagacccgcaaacacgacgctttgtcaatgcttttgctatgaatcaagccatgttcttcttcaattttcagcaggcaatggtcaagatgggtttgcttgatgttaaggaaggggatgaaggagagatcaggctagattgccgcaaagtaaactaatggttgtttgtttcacttgttctagtttgaagcaaatctatgtaatcttatctttatgtctatacgaataaaatggagatataatgttatattgtattatagtatcaagtgatgaccaatgcaaaaacatggccagaacaagataaaaatgatggttagagagattgcatcttaatcaaaagtcttcgggtgtacttctaattttatctgcttgaagtatcaatttgttgcatccatccaagtgagctaaatatttatatgtgcaatttctttaacataaaagatatgtttaaaattatttttatatcttaatttattctgtgagcaatattattatatattatctattttatatggttaacagtagttatccatgtagtaaaatatagtcggctacatttgatccagatccaattcgaacctaatcaagatccgataagcaaactcgagtttttcaattgaggtcagatagtatatggacataagttgactcgaataatctgttgggttgagaattttggctactaagttgagtttggatctaatattaagactcgatcaaaacatcggattaaatcatgatcaacctaatttgataagatccatatgcattcgtagctccgtttggatagtagatccaattggaccaccaagcggcacgatcggggctcgtccaaaatcaaacacctcacgtgcaaaacagtttgcttcccaagctcgcaatacacggcagtacaccctcaaataaatcctccaccctacaatccttgatcgggctatcggccctgatcaacaaagctgggcaaggaaacaccgcaaaatcggaatccagctcaagattttaaattttgaattcgttaggatgccattacctgcctaccggcgaagaaggtatcgtaatcttatcccaatccctcgattaataccctaaatcctactctccataaaagtataattaaataaggaattatctatcaaatttaacggcgaattcacgcaaatgggggcccatccaattgtcaaaatcccaccaaatgctcactaggaatttgcgtaccacaggcgcggtgtagagcacaggaccttatctaattgatccagctatctttttcatttaaaaatttgtatgataaaaatatttttattttttaattaaattataatattttatattcatattacaatattttatatctaaaaagttataatttttgtccatatataattcaggacgtaatatgaacaggatgtcataattttttctaaaagatgatgatattttcgtcattcaaaattttcaaacgaaaaaattgatttataggcattaaatacgtgttaaaatatttttggacaaaaatatcttttctatattataatattttggatcatattataatattctggactataatactacaagatattgtaatttttttaaaataatttatgtgtattaaaaaatgatgattacgtagatcaataagataaaatgatagatcagctaaggtaaaatggtgtcccccatatcgatttttttataccacccagggtgcacaaaaaatttcttatcctcactgattcatccacgtcgaaatcaaaaaaataatcccaaaaaaaagaaagaaaagaaaagtaataaaaatgggaggaaaagaaggtataaaagtatcaagaatcaagataataaataataggatcaaatctctgggaccgatatgtcaaaattaattacattttaatcagtaacaactgacataattaaattctcccaacccctctctcccttcctcctctgtatataaacgcacctccccccacctcgtctcctctccttcctctgtttctctttggtctctatttctttcttcttgtggtcttgtttggggattgagatcgagtaggaaggagatggcgaaggatcgggcgagcggatcggagggagcaccgttggtggtgtcgttcggggagatgctgatcgacttcgtgccggacgtcgccgggctgtcgctggcggagtccggtgggttcgtgaaggcgcccggcggcgctccggccaatgttgctgtagccatcaccaagctcggcggctgctccgccttcgtcggcaaggtaaacgtcccccccgttcaaaagatctgattctggctccacttcaccaacctccgcactcttctctctcttgctctcgttgtatgtggtcaccggcggtgcggatacgagatctgtgatccgagctcgagattcgttcgtcggtccctctccccgggttccggcaacccgtgccgacatcgagatcggaggtgttctggaccgtccgatctagatcggagtgacggaagccatcgccagtttcttttacttttttcgtcgtttattatacgtctttctgggggcaaacgtgcgccgtccagcgtggggtttgacccgagagctcacgtgattcggtcatgtgggccctaccattgcatggtcgttggatctatcagatggacggataggaacggcaccttccggtgttagatatacactaacatataaaactttgaccatattttttatattaaataattaaaggtgtgtttggttacacgttttgatttttgatttttaatttttaaaaaataatttttattttttaattttattattaaataaaaataaaaaataaaaaatatgtttaagaactaacttattataaagtaaaaagtaacatttgagaacgatagatgaaaagatcgattggagaaaaaaatttaaaaaaggagaaagaaaaaagtagagagataaagagctagacaaaagaagaagattcgagcaggctctttatttttagtttggcgtttagatgtgcaaaagtaaaaaataaaaataaaaatttgaaaaaataaatttttttattttatatataaaataattattttaattattttaattttaattttttactttgcatgatgttaccaaatattattttttaatttttattttttaaatatttataaataaaaaatatattttttaatagctaatcagatatattttaaataaattacaataattaccttttaaattgaagataattatagattctccattcaattttttagacatatatattctgctatctaacttttattagatacataatatgtaagccttgtcaatatttttttattaaataaaataataattttattattatcatcactatctaatctatttaaattttaaaatatattacattttttatttttatatttttatattttttaaattttatatttgaataaaaaattttgtatatatttttgaaatattaggtggtatatataattacctccataaaaaaataatttattctaaatgactaaagtgtcagcacggtgacaactccgctaccgctggaacaattgcagcctttcatctatgatgttagaggtccctatcacgaggccctaccgggctggcacttgcgctggtggtgatctcaggtcccatgcgcctgccagaaccacgatgccacttataatatatactatatgcatggaggactttatgtatataccaagtcaatccagattgtctaaatgaaagtaagagcaagccgacaagttcaaatatgaatagttaggtagcgagctagctgcatttctgatgagccggtctgcatacagacagacaataaaaataagatcgatgtaagaaccacataggtacatcagccacatatgtgtatgttactgttagccggtggagattgattttatttcaaaaaattaaattaaaattattataattaaaaagatacatatcaaaaaatcgacgcacgatacattctttttagcatggtgagaataaaagaactcctccaccgccccccctcccccgatggatcttaccttcatacgactgaaaaataacgaagctatccttagttcaaaaaacccatcgagcatatatgtatgtatgtatgtatatatgtatatgtatatgcatgggtgtgcgtacgtatgtgtacactcggaaaagtaagagtggggaccgacgctgaagagcagacatccattttctgcgcttgggcaacaacgtgggtggtggtccgtgcgcaagtgggaattagtaattgttggtgtggggtccattgtttgttgcaccctttttttttttttatagtgaatttataatatattatatacataatgtgaatggcttttatatagtcagtgcttagatcaagatgaccttaagtctaggaaaagtttcaccaaatatattattttataccggtatagatggatataaattttattttgcattgggggaaaaatgatgttatgccaggtaataattgcagttattctctttttgtgtttggatgagatttatctatagctatacaattaactaatgaaaactctagtaccattatattttattatatatatatatattacaacaactgttgattatttgaaatttaatatggtaaaataagtgtcatataataaagtattaaataatatattattttgattaatacagtataataccatttcatctttccttgattattaatatatcatgtaatataataatatcttattagatattataataaagagaaaaatataatataacataacataatatgggtattatacattgtgatattacagattacagtaattatgagacaattatactatatcatagtattatgtaaatattgcagtagtattttttattcattaattattgattggatcacatactttggaatttgtttatttgcttttataatgttgtaaattggcagtataagatcatgtaagtatatgactttatatttctttaccggcaagaaatttatatctatttcattaaataaaaaactggatttgacacaaatatttcagagcacatagatcagaaataaggaagaaaatgaatattacttcacagacataatttagaaaatcggaggacataaatgaccctcaatatacataattgatggctgcccataccaaaatgatgggaaaatcacaataaccaagtccatagtaggtctcctcctattggcaacttgataactgagaagggcattcttcaaagaaaaaaaatacatgaattgtgagttaggctgttgatctcctgaacattttcacataaatagttatctattaaaatgaaattcaatcacataaattattaagctttaggcaatataattaagtacaataccattcaaacaatgttcatctcatgcctcatgagtcatgagcatacctgcagtggagcatgagtagactaaccctcacttctgacaaaatattataagctgaacttcacgtccaatacaagattggcatcttcatttggttatgctggctgcatgccctgaatagatagccatacctggtttcaaccatcagaagccagtgtgtcatcctttacccgcatcagatagcagcaactgttatttggccatccaagtttgtaatccattcttactaaaataattcaaagccaacacaataccatcattttcaaaatggaataaaaattgaaagccatggtaaactatgtcatgcatatcataggcaagaccatacagaagtagatggagatccccagtctttaacttaaatacatgtttgttttcatgggatgactttgatttgagggaatgtaggggtcctagaccagaatgagtcagaacaataattaggagtcatgataatcatagacatctgttgaggaccatatggtggcagtttttctttcttccccttcttttctttgttcttcgtctgagttacaaggcttgcgaatagcctaactgggctaagaaatctagacattttctagatattggaaagaaatcacctgttcagaccaagacaataagatcctgtcatatatgttccactttgaaaccgttatttgctgttatgatggcaataaatttgcccagacaagccaatagatggtctttttggtaaaattcaatggaaattactcaaatcttggtttgaacagtaaaaatgtaaatataatggaccagaacatcacaaaaaatagctcttatttttcttacctgaccaccagcacaagcaaggtagcagctagataataacatatctgttatagaagcaatgtatgatagcacatgcaggtgtactggctcattttctaaaccacgttttagctggataactcaaaaaatatggatagggagataagccatcttcgccaattccccgagctcctctcttcaccttctttactaattcccagctatttggtagatatcacaaaggataggataattgagcaaacattgccttaggtcatgttttgaagttccaatcaccttatccattacatatactccatgcagctcagttttgcagggtagtgaaagggagagggtagtggaagaatctgtggcctctgctctcacacctaaatatatacatgttttgatcctcttttctctgaaacatatcattagtcagtaaatacctattgcagttggatactaaggtacatatctaatttaccaaacaaaagatgcttccaacatttatttttactgtgcttgtccatatttctcatcattttattatattactaaattgtgtggccattgtgtccctaatctcctggcaactgctgcaagtttgtaaatgaagtcattcatcacttttatcgttttaaagatctgggtgaataaagtgaataattggtgcagcaatagaataggatagtgactagaaaacatattccaatgctaagacacaaaactcagcacattcttctctttattacatcacagagagaattttgaacagaatctgctgaatgttctcaatttgcaatctaataattatttttttcaagaaaaattagacttctatggaacaaaacatgctactattgctgcaaaatgacattgttatgtatcatgattcaaagcgttggtacaaaaagcagatgcttatctgttactcatttcactttccactgttgccaagtgattcatatatttggttttcaaacactttcttcttccatcactgcagtttggtgacgatgagtttggacacatgctggttgacatactgaagaagaatggggtggacactgatggttgtctcttcgacccccatgcccgcaccgccctggcctttgtgactttgaagagtaatggcgagcgggaattcatgttctaccgcaaccccagcgcagacatgctcctgaccgagaaggaactcgacctttccctcattcgcagtgctaagatcttccactatggctccattagtctcatagctgagccttgtcgatctgctcatcttgctgctatgcgtgctgccaaggaggctggcgtcctcttgtcctacgaccccaacgtgaggctccccctatggccatcacaggaagcagctcgagatggaattatgagcatctggaaggaggctgacttcatcaaggtagaaaatatactcctcattgcatgtaagaagattaacaaatttatttggtgatattttgttaggaaacctcacttgtatgttctggccttggatttaccaaagttggagagcatgttatagccacctcttgtcttgctagccaagacaaagctgaatttctagcagagacaaaaggtgggtcccatgatatatggattccaagttggtttgtagtggcgtcttatgttactaaatgcagtcatccaagatttcatctagcttgaaaagtgtctagatgatcagatatgaagttggttttcaattttaaactttgggtaatgtgttgcggcaggttagtgatgatgaggtggctttcctgacacaaggagatccacagagcgaggatgttgttatgaaactgtggtatgatgggttgaagttgcttattgtcacagatggcgagaagggatgcagatactttactaaggtatattgtccttaatatcctattggtatttgttaaagtagtttttttttataaaaaaactcaaagaaaaagcagtttttttttaaagaaggaaaaagttatacatgctcggaattgtaggtatatatatgtttcaaaaaggtgtataatttagattttatatcttcaactttgtaggtcctaactttctacattttttgtctttttatatgtagaatttcaaaggaaaggtacctgggttttcagtgaaaactgtggacacaacgggtgcgggtgatgcctttgttggttcccttttggtttccattgccaaggatgactccctcttccatgtacttccttctgccctctggaatcagcttcttgtctgtcataatattacaatcttttaacatcagtgtcattattcacagttattattattgctttgtacctgtagaatgaagaaaagctgaaggaggtgcttagattttccaatgcttgtggagcgatctgcaccacccagaaaggagctattccagccctcccaaacacatccatggctcaggagctcattgcaaagggaaagtagggtatcagtgtgcatgatgaactaaggggaaatttaggtttccttgttagttggttttgatgtatcctctctggttagtctttgtgataagcatcagaaaattttcacttgttatttggtgccactaaatttaacctagtttgtctttggtgcaataaaacttccatctttttggtttaatagcagtgtgtgaagctaccatatatcctttcctataatattaaatgctgattaagaattgtccattagcacaattggatacgcattctcttagttactatatttgtgaggaaaacgaagtcagatgatggtatatctataaccatgtactctgagaacaatgcatgatatagttgtgactgatgaattgttttgtttctgcttcttcctaaatcaaatcatgttgttctctaagttttaagaaggctgaaatgcaagggggactttggttcttttgttcgaatgaacaacctaactgtgagttagaaattatttttctgacatagaagagggttaaactcagccaccgagaaatgctttgtgcaccatgcacaccgcccatggtgattggcctatgcatggggtcaaaagaaaaaaaaaaattttttttggatgccacacctcggctccgtgagccaatcaccgtggacggtgcacaccacctgcgatgcacaaagcatttctcctcagccaccccaccccctcccccagcccaacaaccacactggtttaggcatgatttgaacctagatcatttaccaaccagattagttggaaccactaaatactgttctatttatattcatggctaattagctttaccaatgaagaatttaatagtctacctcagcttaacaagaaaagctccggagttccttttttttcttttgttgtgggggggggggggcggttgtaaagtggtgcttcgttcacgaccgaattcggaaatgcactggaatataaattggaatgcatatcttccgacatgtttgattcgtgatttgaatcaaaaataaaataaaataaaatttggataccaaggagaagtagatattaagtgttagatgattaaggtattctcattttctcttagaatcagaatcgtcataggactctaccaactaatctcaaatccggaatataacacggtcatgctatcgcaagatgttgctctcaataatatgaagcctaacaatcataatcagctaaaatccaatataaataaaatataatgttatcgcaaggtgttgccctcaataatacgaagcttaataatcataatcaattaaaatccaacataaataaaatatagtaaaagattcaattccatcatttatcatataatcaaatcaaaattggttcagaacatttaaatcgaaaattaaataccaaactcatatctcaaaatttataaatagttaactataagtctatgatcattaaataaattaaaatttagctacaaaaacttcaaactcgctagcgtagatcctcaagtctggatcatcttttatttttaatctctatggaagaaaaaaaaatatgagctacactagctcagtaagtagaacctacacttccttatcaaatcaaacatatatttttctatgataatacaatatttagaaagtaacaaataattcaaaataaaatatttcataaagtataaaataagtcataaaccagtcgtgcatgcatgaacattttgtaaatatgatttgtaaattattcttatcagatattcgtgtaatgtttcaaaaaattactcatagatattcatactatggtcattttatatccatgacagggccgtcaacgtagtcgataagtttcataattcgtattcgttatcaatgttatacacattagcagagggtcatttatgaaatttcatgatttatgcatgcatgactggtttatgacttattttattatgtatcttatgaaatactttattttatattatctgttattttttaaatattatattatcatgaaaaaatttatacttgatttggtaaagaaacataatttctacttactgagctagtgtagttcatatctttttattttttttcttttacaaaggaataagattagaactgatgaaggatctaaacttaaggatctgcatagccagcttgaaaattttgcagctgaaatttagtttgttgattatcatgcacttatagttatctatttatgaattttgaaatatgtttgatatttacttttggatttagatattctgaattaattttgatttaattacatgacaaatgatgaaattgagtattttattatattttatttatgatagattttagctaattataattgaatggcttcatattatcgagagatgtatctctcgatagtataaccgtattatatctcgaatttgagatgtgatatttaataatatcaaaattttctcctaaaatcagaatggccatgggactccaccaaccaaacaactggaatgatctaagtccaagaatgacctgctagtttttttttataaagaatgatctgcaagttataccaagtattcaatcaacttcagctacgagacaagcaagccaatagaattcattatctaaataatattaaaaagaattatttataaaattaatatatatttaaatttatttatcaaactaatctaaattcataaaatatcatttgaaatgatattttttttgatgaaaaaagtcattccaaatgatattttatgggtctacgtcacctcctcccccatcctccgtggactcaaaaaaaaataatcaaaatcaccaatagaaatggtatttttgaaagtgccatttgaaatggtgttttagaaatggcattttcaaagacgccatttcaaatgacgttttcaaaataaaaaataaaaaaataaaaatagctatttgtaatggcattttttgaaaatactatttgcaataatattttcaaataaattttaattttaaataatattttcaaagcccttcgatggcccaaaaaaataaaataaaataaaaaatagaaaaccaatccatatcatctccgtaccaaccaataccgatgccataccgacctataccgatccaaaccgcatcgtatcgagcggttggtgcctgcaccataccgtaccgatactttaccgacctgtatcggcccctaccgcaccgtatgtagcggttcatgctcgtaccatactgagatataccagtgcggtccgattcatctcatttatccgaaaaatcggtctgaaccttgttggttccccaccgatatggtacgatacggccgtaccgatcggtttgagtcggtacggaataccatgcatccaactgtagtcctagtagatttgagtccgacacaattgtcccatcattccttatcaacttggaatcctcatcctcatcatgattcagaatgctcttttcgtcgaaatactgcagtctattatccgattgtcaggcttcaatctttcatcgaaataagctctcaccatctgcttcgcaatacgtgcataaaaatgtatcacacccttaatgaaaaaagatgagaagagagagtaaatgaaagcaagcataaaggcggagagagagctgtgaatatcagatgacattctatcgcagtctcccttcataaataactgacttgtttgatttagctaatttttagctatttcaagatatataattaaattatgtgatatattattattattatttatattataatttctatagcccttttagcataactttttctttcctaatcttttgagacacatgaaactacgtgtatccatctacaaagcataacatctgatcacttgaaattaaattaatctttgataaaaataataattaataatataaaatagaatcaaaatatcaagtgtataaaaaatagtacaataaaaattttaaaaatactaagtacaaatctaaaaaatactaagtcccacaaagacgtcatggtacccgtgattgcttgggtcttcttaggaaggtcctcaacggtcgctcctactcctgtatctgctgtgatggctcctctcccatatcaatggaggtctgctgtcatgctactcaagaataactgatgctgtcggagcatctgcaggttgagtgaccccctcaaccccctcatctggatatacggatgggcctgaaaagaaagtgtcatactcacgtggctaactgatatccgatgatgttatctagggcatgtaggaagaagaaggtcctgtcatctgtggatcaaaaggtggtggcatccgtgcagcgtgtagtgatgatatctgtggaatatgcagtgatggcatatgtggaacatatggtgacggcgtatatctcatatctggcgtatcgattgctccatgccaaagcgcacagctatctgggtcaacgtcaatcgccaccaatgttttcgaacttattttctctatctcatgtagtattcagatccgctcgtcctcatcagtcgtagataaagcacgacaagcatccaacatatggtctgatatagaatcagtctacataataaaaataaaattagcaatatattgtaaaatataaaataaagatataataaaactacataaaatattttacaatcttaattattagaagtaaagatattgatataaagtataatttttgtgatcttaccaaaagatgcacagcagaactctcatcctcgtatcctgaaactgcatatcaaggctatccaatgactcgcactgtaatactaaaaaatcaaaccatgtagtcctcgatatatggacggtctctcaaaatgggatcaccatgaactatgtgatctcgacgtgcatttcaaatggcgatgtactctgcatatttgatacgccagtcaatatgagctctccttcatcgatcaatacgatgaagtctctggctggtatcaaactactttgagatgccctgaatctaaccaaactgtcgtttgacatgatcgaaaagatgccactccaccatatcaaaacaaataagtgacaccctagcagtccatatatcatgtccaactatacacatctgcggcaatatagccaatatctcatctgtattggacaattaggaccagcagtaatagaatgttgttttgcaaatatggcctcaacactatcggtttgcaccataggagttacgaaaggtgaagaaggcctaggagtattgtccttttgggttaaaagccgactatagtatccaaagcccggtacatctttcttttcaatatataattctaaaaattgacattctgaatatttcaaagaaaatatcagtatttcttggacatctttatcgtcatcaattggaactaagatatacttgctctgcattaactgtcccgacaaattagaagatctctatttcaattttatttcatatttttttttatctacagaaatactactgtataaatggtccaataattcttgacctgataatgataaagatatcttaatcatctgatttgtaaggtgactgtactgcacgctatcttcgccattctgtattatgccatcataacacaatagtagatgaactcgaatactgaccattttctcagaaaaatctatgataatatcaaaatcaaaaaaatttagtattaataattattttatcatttcaaaagacttacatgataaatgcatcctatcatcaactaatagacaaagataaatcatatcccattcaggaattgcatcaattctataagttaattacagtaatcaaacgatatacaatagggaccgaaaaaaatttcaacagtattttttcttagttctcccaatacgactgaaaatgtatgaggagaactaaagaaaaatgctatccaaaatttctctcgaaccctcagcatattgtttgattactgtaattacctatagaattaaatataattctcaaactatccaaactggataatcaattaaccactgtatatattttacggcactcgtacaaaaatatataattaaattacaaaaatttttctgaatttaggttgagattatacttaaatccattattttgaaatatgtacacctacagctcggcatttacaaaaaacctataatttagtccccaccttaagagggtacgtgtagatttttcgtagacgttaggaatgtaagtgtaggtttttcaaaacgttaaactcatgtggtaatttcgacctaacctcaaataattttttataatttattcatatatttttgtatggatgtcatagaatatcctacattggtcaactgacggatctacagttctataaaatataatatatttaaaattcttaaattagcctaagattcatttttaaatcaagtctaaatctatttaaaaaatatatatagcaaacaacaatattaaccaaattgattagcgatctctcatacattgcaaataaataataataatgataataatgagataaaaaagataaaaaaataaaaaagtggtggtggtggggcaggaaggtcgatgggaaggcaccgaccgggagtgccacgatgggagagcgtcgggcggggagggagacccgccaggggtggtgaggggggcggccgctgccgacagaggacaaaaggggggtggttggggaagggggtccgccgccacccgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaggagatgggggggcgatcgccgctggaagagggagagaagaggaggaagagaggaggaaagagagaagaggggggaagagagacttactatgccatggagagggagatcaccatcggagagggagagcgccaccgaagagggggaaggaagatatatttttttttggtatataagatgaattaacgccatttgaaatggtgtttttaaaaacgtcattttaaatgatgattttgaattttttttttttgatccacggaggataagggaggagatgatgtagacccataaaatatcatttgaaatgatatttttcaccaaaaaatatcatttcaaatgatattttttaaatttatattaattctataaataaatttaaatatatattaattttataaataattttttttaatattatttgaataatgaacttcaagtcaatataagtggtgtcagacaaccaaagacattcaaacagttgaattgatggcacctagggctgaaacacacagcgccaagcataaagaaaagggctgttttgaggttgaaactaatgtgcttgttgcgtatgatgtatttctttctttttttttttttttttgaaatgaaaatatgggggtgggagagagagagagagagagagatgatttgagcaataaacatagtgcaaagcctttgagaaatggtacatgtacattaaattagcataacattgcttcttgaaaagcaatgctcgtatacaaggattcgttaaaaaggaatgtttgtttacaacaatgataattacatctaaacaaatgaaattgagacgtttcaggttaatgaagttgataaaaaaaatcacaggttgatggctctggatgcaagatcacggtctcccaccaagtcaccctccaattggttagcgtctgcctgcgatcaccactttatgttacaaactgaagagagagaacattttctcttaaaaaataagcttgaaggaatatgttttagcaaggatagaaatagtataagcttggagtcaggcgatatggaaaacttcttatttccaaaattaaggtcatgtcaggaagttgatttgtgcctattggtgagaggttcattcatttcccttagtaaatcttcacttaaattgatgagacattcgcatgcacgacgcataaaatggcttcaaacgatgacagccttcctgaaacactagttttctcaaattaagaaagagaaagatggcttttggttactccccttgtttaaacttcaaaacatgaccattactaaatggcatataaagattcatgcatcaaagcacttgcttggatggtatcatcccttggtacttgcgtaagggggtgagggttcgattcctattcaagggtggggttgggtaaatggtataaaatgtggggattagctttttaccataaaaaaaaaaaagtaggggattagctcctcagaaatctcaaaaagaaagagggggagggcggggggtgcattgatccttcaccttattttgtgaaaggtagtgttctaatgcaccatctccttgaagaattttagctccacagcctggtctgtcgagggaaccaatggcctcctcatccaccacaactgcatccactcgctcggttcctgtctttacatctggaatctgggaaaaaatgtgcatcatgaaaatgggaaaaaatgtgcatcatgaaaatggagcaccgccaaggtcaccaataaatttttgatctcatgtcaattatggaaaatgaagaccataaattaaaatacttgcatagaatttaacaggctcaaacagttacgtatttttaaactttctttttactaaattggagattgtaagaatggttaaaatgcacaaaatcagtattggcattcaaaaaggcttcaaatgtattgggtaaggtataggctgccatagcactgctggtgcagaaatctgacatatatggtggcttgttttgttcctctctagtagcgcaagttgaagaatgcaaatatacaccctatagataagggctgagcccaagcaaaatccaacacaatttaaatttttgaaatggataaggggccagaacaggcctagttgtcagctgagacagaaacatttttataggccaagagaaagcacctgcttgggaactgaaatttgaatatggaatagggctaaagccaatggttctggcatcaagttccgcttgggtctacctgacctcattacatccaagacatgatttgatccaacctgtgttagctctgtcagatctacaatcttggaagtgcatgcagttcaacctctgcacaattaggatcaggccaaagctagtaaaatcaggtcgacttattgattcagacagacttgcagggcatcagatctacttgctcaataatgtttgatgcctatgggaagggaaaatatacatgtccactcggtgtcgcatgcatagactaaattgcagataagggtaattaatttacaccaaattttcagctctctgctattattttacattcaaaagtgttctaaaggcatcaaacccaagctcaatttgacgttaagatgttatgctcaaaggttcaaaaataatttcaggattctactgcacattcaaactcttcaccataagcttcttagaggtttaggtcaattggaagttacattgtggagcacttgcaagcaatggttttaattgctgcttaacaaggtaaaattttagaaacaaaagagaaaagtgaaagaaccattaatattagtcaacaaacatacctcatacatggcttcagtaagagtactttctaaaatagctcttaagcctcgtgcacctgtatttttcaccattgctttttttgcaatttccctaagagcagcctctgtgacatgcagtttaacctggaggatgatacaataatgagagccaaggtaagaagcagcttatttcagaggaacatagaatgaatactagaccatctacatagatgagacacgcttacattgttcatgctaaacagtttcttgtattgtttgccaagagcattctttggctctgttagcacctgaagtcatatcaggttaaattaaatgaatagcttcacaccaacagctttaaatgtcagcatcagcttgtcagtgaattaaaaaaatattactttaagtttgattagatattcatttaactcgatcaattagtacaaaaataccattttaagtctaaacgaaagtgagaacccagcttaggcaagtactgcatttagaggagatgctatccagattggaagttacctgaacaagttggtcttcatttagagccgacaaactaactaaaattggaaaacgtccaatgaattcggggatgagaccatatgctataagatcactactttcaacctacaaacataacatacttcttccatgttaaatgtatagagaaatgtaagagaattctcgtgctttgttaaagcatgggaaaaaagatttggacacttctagacgtgaaataaagaatataggcaaaagtttaaaacgaatacttactgattccagtaaggatgatgccactacagcattggttaaccaaccagttctcatatttgcacgtacaggtgccccaaatcctatcgaagaatcatgccgtctgtggaatattgaaaaataagaccttcctcaagctccatagtacaagcaccagagtttccagagaagactggtgcacatatctaacatcatgaaatagtgttacctttctgaaatggtcttttccaaatcaacaaaagcaccaccacatataaaaagaatatctttcgtatctatctgcagaaagcacatgcattagttaaagacatataaaaccagcataagtttaaagtatctgtgaagtgattcaaatatgaagtcatattactgcaaagttatgacaaacccaaaaaataattgaaaactgacactacacttgattgctcagatcatcttttttatttttcatttttttttttaactcttgaatgctgattgttgagacacttaaaaagatgggaagcaaaacttgatcagagtttaattaattattggtttgatgtagaaacattaaaaaaaaaaaaaagccaatttcatatctactcgagaacttgggcaaaactttaaacaaggaacaagtggacaaggcacttcatgcgattttgtaaaaataaatataaatcaatcaacaatattatagtagagctgtatatgaagacaattttatatcagttttcccttttttcttggtagtgacagctcaatttacttgttttaagaattccacgtaaaatctcatgaactgcaatatttacagcattttgctaatactaatcatcaccaaatctttgatcactgctttgtaagccaactaaattggtgttgaaggttgtacggaaggaggggaagtcttaaggtaacatagatagggttgtgagcaaagacatggagaagcttgaaataacattggaggtatcccaaaaaggactacatgggaaatgaggatccataaagcataccctaaatagttaggataggccggatgtttatggtttcgtaagccaaagaattataattggcagtatcatgttgacattgattctcccaagacttctcagctgaaatgttcccttttttaactttattttgaaagacatttttgtgaatatttctaatcagatatattctgagaaaaaaatagaaagagcatcatcattgttgcttgatgtatgaaaacaatgttcattaaactatatgctcccatgcatctgttattacgaaatccttctatgcatctgttgtgtgctaaagactattcctaggcccaatcttgcctactacgaataaccaccaataataagaagaaatatgggaagaaagatttgaaactaatggaaaatagatggcactgtttgattgagtgaataaagccattagccccaattatttcaatttttggttttaggattaggtagggttttgagcctatgatttggattaatgccaccaatgctggcctcagcaccggtgtttcaataaatgtttgggaaaacctaccttgagctcttcttctccctgtcttcctctcctttctctcttctcttttcttctctctcatgtaaaattagagacagagccctgggcattttcaccaagtcccagctttgacctggttggtactggctgacacagtcactgacccagttgatgcagctgatatcaacgaggacattgggatgccaggttcaaacggactttggttccgtagccatcccaggagccagtctctcaccagtcccacctaggatggctgggtaccagatcctcgatccataatgcaagtaatttcaataatctattatttaaatgggtgatgctctgaaaaagaaagaatacagttttcgaaaacgtttatcgttaaaagagcatatttggatgaatttcaacttcatcattttttctgtttatttatttccttcatagattttgcacatctatgcaactagtctagccttctcttccgaattgggtaggtatcttttaatggtcctttgtatgtttgattgatgatagatctttatcatacaaggataacttgcaagatgaagttcaaataatctttaagcacaagaattaaagattcaaccacataacatgtcaatctacatctgcgagactataaagcatgaaccaggatttacagtatactctgacttataaaagggaaagaataaaagatgctatggtttttgatggaaaaatgaatggtcatgatacaagaaaaacccatgcacgcaagctagactatgatggagattttaaaaaaactcctggtcatgctacaaggagcagcttgaacttggacaacaaacatgcggatctaggttccaaaaatggagtgcccataccatacttaaaacaaatacatcattcaaaggtataatttttaaaatacctgtatatggtcgttacgaggatgcttgcgagctcctttctcaggaacattgactatctggacaataaaatgttcaactgaattcaaaagataagataagtttctcacttactataaacttagtaactaacataattgtaactgacagtattcattcatttcaaaatagggcattcttttccttttctttcaaaactagaagaatacacccatcacataggtcaagattactttcgtatttaaaaaggaaataagattagtcatatttaaaccataatctggcaattttaagttcaaaagtataggttccagaaatgatttttagtcaagtctttggagataaaacattttgcatatcacaaccgtaacaaaagaaagattgcatagaacaaatgaaaaacaggtttctgagacacttatttgaaaaaatggggaccgtcatgtgaaatgctttttatgttctcagggaacttcaaacatgcagaggttgatatttaaacttcaatatgcttttaaaacattgattgaaagttttactcaacaaacttcatgttttattactgatcaatgcaattaccatttactctgcaagtattttctcaagtcataaagcatgagaatttggtatgtgcttatgaaaataaacttaatctacaaacattgattaagttgcctatgaaaagcagttttgatttaaggttacaagtcatatattgaagaaaggaaagggatataatttatgcagatgcaagttgtgaaattatgccaatttataattccattgttattgttgggaataacataatacagtaagagggcatgcaccaagggtcaagtaatctacatgaagcacatttcagagttaaacttcacagacagagagaggaggggggaatggggaaaaggctatttgtgtgcgtgtgtgtgtgttgtgtggcgggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacaacaataagaagaagagagagagagagagagagagagagagaactaaggaaacctgtagggccaaattagaattttttttttctcttcacaccaaaaacaaggggaaaccaattgaggcggaccctatctccatgtttatgatgcatcacactccttcaaattgttcttttcctcccaaccaaatttatatatcagcgaaccacgcttctgcaccaaaaggacaatttacaaaattttactcctttccaatcgttcaagtatgggaggtcacgttccataatgtaccataagacagaacaccctagaattccatctccacttaacatgctcagaaaaatggaaatcttgattctccagtttacacaataattgttgcttcactataaactttaggtgcatatattcttatcaaaaaaaagtgcatgtgtatcacatcataatcacaagcagtatttcgctaaaaggttgtccttagggcacagaatcgcatacatctttgccacgtatgccaccatgtattaataggtatcattctgtgtcaacatgtattgctttaatacgcatggatatatcccaagcacataaatgcttgcttgtatgacactttcccaaccatctggaatcttccctagtggtttttcttttgccttattttataaggattggagttttgaacatgataatgacaaaaatacatgggatgaaatgttagacttgaaagtaacccatagcattcaagcctctcacagtaccacctatcaccttgcaactcctaaaatacattgttgatgtgtaaacatagttatgtgtcgcttttgcagtttttgccatgaaattcatgacaatttatattgccaaatagcaaacattacagatatttagggtgatatacaattcttgcttcctattatcagttaaagaaatctttatttgtttaaaacatgtttatccacacatgtagagcatttaaaattggttaatattaaaaaaaatgaattatgaatcccttttacaacttgtgtatcatttttcaatccattaaactagcttcaagctttaaggttttactagagaagacttaaaatcttcacagatttgtcagttaaattgctatttacatgaagctctaccaccaatttttgactattaaaactggttttgaccctgaaaatattttttaaatcaattgaatgggagctaattctcccaggttggtatcaaaatgtcacaggttcaaatccccatttagaccattttttcttcataccacctgtttcttttcttctcttgacttgctcctggttgagacaattttgacttgttcttgagtcatgcatggtccaggctacatgtggttttagcagcataagcatttgtggtctagtggttacttaacagtcacaactctcaagtattatgaagtaataccaattgagaaaatattataaagtaatagtcaaagtacatgtcacaaacatggttcaatatgattaaagtaataggcaagtgtcatctaagaaatttatgatgtttacctcccaaatttttaaaaataccaaccttctaatggcaatgaatattcaaatgccatcatgtccatcattagttgaggttcatgctgtattaccagaactcgcaacagaataatagtaggcccctaagaaagaccagtttctagtgaccataatgcaaaggaatttttagaacatgacattactctcacatgtatgataactttattcaaaaaaataaagaatagaataatccagaatcataccgtaagcaacttgtataatattgattcgacatcttctccaacataacctgcctgcagagagattttactctttcaatttacagtaaagaatagccaggccaggaaggctaggaggttgccatcagcttgacaactattaaagcagaatggtcaaaaaatggtgtcgtttgctttctttagtcaatgttaacaaaaaaaaaaaaagagatacacacatcagtaccgattgatttatgaaaagattgaccatgttttttaatgtataaaaataaacccctaagaagaagaacccaaatgaaatgaacaacatttttgctataactaggattaccataagaaaaccacagtataaccccaaaagataaacccactaagtatttcagaagatgacttctatgactcccagatattgatacaatttcatttcattcaattagcatattgcatcatttttcataaaaaatgcccaattgtttaaccttgtatttccatgttagattcctatcataaggaagctcgcaaaaaaaatatgatttgatgaattttttttctcaattattcataacaacacacagagaatgttcccctaacattgactgtaatttgactcatttaattaaaaaacaaggaaaagaattaaaattcagtgatattatggaatagtatcgtatattgataatgcagttcaattggaatcaactgagttgttaaacaaatccctcgttgaaaatgatgtccatcagatgatcagcaaaacgaaataatatgaggtaaggttcagcaaatttaaacatatatacaaacatataataagttagaagatagtattttgcaaatgagtggaaaagaaattatgcaatatcaataaattaaggacaagaaggttatgaaaaacttgcctgtgttagcgtagttgcatctgcaataacaaatggtacattcacaaagcgggctaatgtttttgcaagtaaagtcttccctgtccgtgcagataatattacagtgcataagtagggccgaccatcaaacccagaaaatttaataaaaacaatcctcaggcacctcaataatatattaaaatttaaaacacttaattatagcaatgaggctgtacccgagccagtggggcccatcaagagcacattgcttttctctagctctacatgatcatcgattttagcctcaagattccctggatcagctgccgacctggataatagatcagcatattcagtttccaacaaaagagtagcaagcatccaagctttaccacctgaaaaatgtcagtattaaatctcgttcagtcagagatagagtatttcttaagaacaggggtggcaatttctgacccagaccccacagacccactgtaattcaccttaaataaacaagtttcaatgatgtgtttttataataaggttttgtttcaggttaaccaagaccaatctgattacaacttggtcaggcttggtttgtcagccagacccaatggatcccatggcctggacaagtccttaaacaaaccttaggcccactagaacagtagtaccggtaatctagttgaggcttaattgcatgattagggaggctatatgtttcatagttaaagagaaagaagaaaaagactgaataaaagtggagcagaccatgtctgggatttatcttgttctcttttccacttaatttcctctctctctgcatgtgtgtgcatttggattcacactcctatattccctcctttggccctatttcagttttgtttataaaggtatataattgaaaagtgaagcactaaattgtgttggtggattgcatatagccatatagatctgcacgaaaaatgagctagaatgggtttaattttttggaaccaattacaaaatgggttttgacccaacctaaatataacccacccaatgccactgctactcaagaatgaaaataaggatataacaaaccctttctgcaaggatgcatggtagattcgtttataatgattgtagacagccacagataggacctgcaacatgatggtgaattatggaaaaacgattaggacaaaatgccttagaaactttcatcgcttcaaaagcatggaacatattttccaaaacaacttagtgtttgatccaaatatccaaaaaatttaataaaaggataaaaaagacaaaggttcatacacctaaaaaattatccatataatcactgctgtaacaagaaaggaaataatccattagagaaacaaagacgtagataatcaccttcttcatgcgagagccaagaaacagaagtaaaaaagtcttgaaaattaataatgttaaaaaaaactgattgcttttcaaagtgttggagaacttctgaaaaaatactggcccatcttaaaatatcataatgcttagtcgcaaggtgtaaagattaagttttgtgacttttagcatcagtagttcaaagtaactatatactgacaaaaaaaaaaaggcaggaaaactccaaattaagcaaacttctgaaaatgtggactccatattaaaggtgaatgaaataagctatccagatttattatgagtcgaattggagctcaaattctgggctcataatattgagttctcaatcagcttgataacataacaagcataacccaagctaggatggactaatcttacatgagctttgctctttatattataagatcatagctgatgagctaagagatccaagtcatggaaagcttattacattctgacctatgcataaacaaaaggaagtaatgtttttgggtcgtactaagcacgacgctttggtattgcacatgatgtggcaccagctcaagtaaaacctgtgtcagggagctaagttaaactgaatttgagcttaaaagaaactgaacaactactgaagctgagacaggaagagactggataagattagcttagaccaagtgtgctttgaggtttcaagcctgatttgaaccaggctgagcatgagataagaaaagactgaaggagttaaagcagagccaagcccaagtcttgaggttttgacctttagaaacctaagttcaaactagctcaattgactctcatacgtacctagtggtgtttggccaaccataaggagagggaaagagggagggagggagggagagagcaatggaggctttcaaccatcgaggggtgtacacagagatgttggagtccatccccacttttcagatagagagcgggtccggcctgcttaatgggtccaggtccggttccggacctagctgtcacatcccgtctctgctaaatgtggcacaagttgagggaagctaaacttctctttaatgtagttgtatagatttccattattgcatgattaaaaaagaaaaaagacaaacttgaacttgtgttaccctctctctctttccagatgtgaatatgggacagttatcatgattcatttaggagggaaaaagaaaggatggagtgtgtgggagtgggacttgcagtgtttgaactttgaaagtccatcctaataatttaaggaaccacatttttagttgaacttccctttaatgtagttatatatagatgagatatggaaccaagaatgtgaaattgctttctcaacctaaaaaggatttgtgctttcatataagttaataccttgcagatggtaggttgtgcttgtacacttactcttcacataaatagagtaaactttctaacaccaatgtatttaggcatctattatcatctagtgaaacaaaggaaatgggaaattgtgtccatagatgccatcccaatagtagtcctatgcatatttagtcaagccctacgttaacaagtacgaaccacttagtacatctgcctataccctctgctttcattttaagaatacatactcatctatggttgattggtttcttccacgcccactaaatacctaggttcccggtgtctcactccttgaattaatttatcatttaaggttttttcagcattttcttaaagaatatatgaaaaaggaagcaagagatgcagatttgcgggggactcagatgtgcaggactgcacagtccttttaagaatacaagaatatcacattggagatctggtagtgcaattttcttaggtacagaaaagcaaaactgatgggcctaagaataacaaagaagaggagagaacgagctagaatccactacaagaaaagtaaggaaatgattgaaactcgtttgaactcataacttaatcaagattcacaaccaatttcacagacctggatcatcctggatatatcatgaaggcctttaaacggttacattagcatttcattatatttgaaaaagaatatccatcatcacattagctaagctaagaatcctgaactagctcaaacactatatcattagccaactcatgaatcttacaattcccgttggatcccaaactacaaacatggaaaccgttaatacacagaaaaaaaatggacccttaaacaaccacaccgaatgcttattgaatcccattttttctaaattctttcctttttccttcctcaggtgtttcccattgaaagaataatattagattttttttttttttttttgtcactttacttcttagattgtagataccatgtcatcagtctttcaaaaatgcaacaaaaagaaaaatgtagatcgttcaatttgaattagtactcaagctatacaggaatgttcatgtgaagccctcataagtcgggttgcatcgaaagaaagaaagaaactataccaaaaatgagaaatactttcttctgtatatttatttagaagtatcattatcaaggaaaaactattcacggatttgtctccagatcctcctaaatcatggatatccataaatgaattgcgatctaaaatgaaggggaaaacagctacctttttagcacgctgctggccaattacaaacgtatcgagccccttgcagatctccttcggcgtcggcagatccttccctaaattcgacccaccacaccactccttcccaccaaactcacccccatcgcctgaattcccgcctcccccgccctttctgtatccccccactttcaccacattcacattcggcggcccgggcggcacatgcaccgccagcccattgccccccggcgccggcgccgggagcggcataggcggccaattctccggcggctcccctccatacgtcgccttcagcgtctcccagaacgtggaccttatccgattcccgatctcctcatctccctcacctccaccgcccttttccttctcgggagtgtcccttctgacccgcccgatctcgacgaagctcccctggagggggacgagccgatgggggcggaagtagaaggcggtcctgcagttggggcatatattgacggcctggaacccgccgccgcggtcggacgtggcgggggccggcggtggcggtggtgggcggtgggagaagaggacctccatgtgcttggagcagcggggacagtgggcctccgcccggatccgcagggtctgggggggctcttcgggacctccacccccttcccacttatgccgctcctgccggtgcagctcccgccgccggccacccacggcgacgacggcgatggcccccccgcgtcgcgtgcagatcggcgaccgctgcgagagcccgtgccggggtgctgcgccgcctccggcggcggcgatgcctcgcgcggcggcgtcactcagcctcctccatcggagaatcgctgacatcttcttgaattcagagagagagagagagagagaggctagtcgcggtcgggcggagtttttatgcgggaaagcgaggatccaagagtacggtgatagatgtggtccagcgagattgtagcggtggatgatacggtgagggtaaatcgtggccgttgaatgagggcgacttcgacggggaagtggaccggggtggaaagaaggctcaacggtcaacgaagcgtgggccaagcattgttaacggcagcgagtttggtgggggtgggggagtttggtgggccgaggatgaggcgacgttgttcaaggactaaacgtgaccgtggccaagctgaagcccatgaggtgaattctttgggcaagcttgccaatgaaagactagttttgtctagcttcgtatatatagcagtttcaggttagtctttctactttggtggatggaaggtgacatttttttggaagccatgttctggtttatgccaaggcacagtttccatgtgagatggcatcatgtccaattccatctccatcagttcgaagaaattgatgtgctcagctgtttttggttggtagtcgctttcaagttttcagacaagataataaccaattttatgccctcgatattctagatccaacacacaattgaaaaaatgaagcacgtaattagcatgtggtgcatggaaagattgcctaccatgagaccgacattgtcacgaaaatttcatgttggttgtagtgtgtccagagcaatgaatattcgagtggagttttattttttgagaaaatgagaggagattattagcactaactcatgcatgcacaggatccaaacctaggtcaccaataccaacttccagtgagctagttggcatccattattgatgtggtcattagatacatcttcggatgatcactctatgcatgatacaaaataactattagattactcgagaagataggaaagaattgtaagaagagaaaatacaggaagttgtagtttgttaggcatctttagaaaaataacttttgtaagttaattttgttttagtataaattttgaaactactggcatattactcacacaatgcctgggaatttttttatttaacaaatatatcattttaaaataatatttttatttattatataattttttagacattaatatctattctattattatataaaatttttattttattgatgaatgtatttattgatttttattaaaatatcatattattaatgcactaatatattattttatcaatataaaatttaatttattaatatattattaatagatcatttttattcgccgacggagaaggtggtgagggcgtaagcaaggccagggacagtgcagaccttctaggcgagggtgctctccttaccatcaaagagctcaacggtgcggctgcgacgagggacgaagaagtgagctaagtccaggtacttgatggccttgggcagacgcctatggactcgtagtttctccgaccactgaagccctaccagaatcgcgtcgtcgtccgcggcgggctattctccaaccacaaaaccctccacccctcctccgccaccgaccccatcccggcccctgctcttgtcgacttccatgactgagaccccgattaccccctcctctgctgtggtcgtgcctcccccctcgcttgctgccaccgatcgccgcctacccccccccaatcaaaacctaagaaaaccctctgatctccgagacactctccttccccatggacctcccaaaaagaaaaaaaaatgatcaatctttgtgggaaaagatcttgcctcatttttcgaaaaaatgagtgaggagatcattaaccctaacttatgcatatgtaggatccaaaccagatcaccaaaaccaactttcggtgagctagttggcatccattattgaagtggtcattagatacatattcaaatgatcatcctgtgcatgatacaaattaaataaccattggattattccagaagataggaaagaattgtaaaaagagaaaatacagaagttgttgtttgttaggcatttttagaaaaataacttttgtaagttaattttgttgtagtctaaattatgaaactataagtacagatgtgatgtacctagtagtcgagtctacaagcaagaatgttcatatgcatagagagtccaaatgagcaagtgatccatgggcagtccacgttcgactttgatggcttcttcaattagggttccaggatgatcttgaattctcagagaaaaatataaacgtagttgagcttgagacatatagagttgctactaagaatggttaagctcaggttagatcaagtccaggtttcactaaaccagaccatgtccattgagattttggtgtttcatgtccaacttttatttcatacacaagctcgagtccaagtcaggatcggtcaaaataaagttgggtgtcaagtttgcgggttaaagtggtggcacttaaggtcgacaaataaaaaaatattttatatatatatatatatatatatatatagcgtatcaaatgagaggagtgacttaatatgaaaagtgagagaatataataataatctttatatccacatcaatggtccagatgagcactacgtgcgtattaaaaaaattaaaaaatgaaggaatggataaatcttaggggtatttggacagtttggacgatcgcattctcatttgaaccattaatatagatccaaaaattattattatatattttcacctctcacattaagccactcctctcatttgatacgctttctctctctctctctatatatatatatatattgatcattatcaaatattatgtctagaataaggctgcaaatgggtcgagttgactcatgattcgatccagtctgacccgtttagatccgatcctatccattttagaactcgtgggatcggatcgaattttaaaattggacccgttcaatattccgagtcgggtttgggtttactgaattaggatccaatctgatccgatccgatctgaattgagtattaaatccaacatgtaaactatagaacaaatagagtaggattagaatttcaaatgctcttgtagaattgttattttttatatagttctacttaatttgactatgaaattttgagaaattgcttataaattaatagctaaggcaaagtaatattttttttcctttgtcataaacttcgcatacgttggtttatcatacgaaccaagtccgatcaaaatttggatccgagctggatccaaaatttttaaattgggaccggattatatgtggatccgatccgatctaaatgatccaaaggaacaaactttttgatcatggatccgatctgatctcacccgattttcaattgggttggatctggattcaacattaggatccgatcaaggagtcggatccgatcaggatcactcattactcggtccgatctgatccatttacatctctagtcaagaataaaacatcctggccattaaaaagcaatcaagtggttgttgctcatccaccagcaagaaatgtatgtattaagagcattggggcattcaagttcttgctatcccattgagctggttgtgagcccatcctagggttttatataattcagccaagcatgagttaaacaaagatcaaatttagcttgattatgatacaagttgagtttagacatggcctagctagcttgaacgcaacccacctatgtcaaattcaatcaaatataattaaatttgtcctagttcaattgcctcatccatatataaaaacatgggactgatttttagtgctcattaaacaaaactaacttaagtcatgacaatgacaataggacttcaaaattaatggtctatcctattcattgtttcctgcatatatacaacaaacaacatcacgacatgcaaaagggtgaagtaatacataatcatgtttgtattagtgcttagctctacgtaatcaaaaaatatataaatagaaaaaatacgtttttataggtggatcatttgaatatttgcatatctcatactctccaagcatcatcttcttttcctggaagtttagacaatcaaaagatgtttttggttggtgccttgtttaacattacccatgcaactcacacgctagaaccatccccatgtatgaataaagaattttctggggatagatcatataattccattggtttagaccaccaacaaaagtcatgcaaggaagagcaagtaaacagagtctcaccgggagaagagaagaataataataatggaatatgaaagcgcggaagccttggggcacaagttctgtgtattagccccagcaaattttgtacttttttagcttgatcacaaacaacatagtaccaggatagatgataatgaaaagctacgattagatctattttgagaactagcactactgtaattcttgctacctattaatcaaaattaaaatcattgaatatattgataataaattcgatgcatatggtattcgttgcaagagctagaaaggctaatttattggcattatacaagattgaatggcatcttgaacaaaataagacaattaacgttcattgagatccgaatcaaaattggtatcagaatggccctctgaatcggaatagagatttgaattctttaagaaagagtctggattgaattttatgagattggaccatttatattctactccggaattgaaattagaatggatattttccaaccaaatagttagaatgggagtaacccattccatttctattttaggccccaattctctccaactaaacatcgaaatcgaaatataatttaaataatcgggaagagtagagaatagattttgagagattgaaaaattttctcaaaaattggaatggaaatagaactttctctaaccaacagctgaaagggaagttgctcgttctcattcccatttgagactccaactcccttcaactagatgtctttcgttcagaaaattttaacatgttcaacctgaaaggaggtatccctgaccaactcaaccaacatctgagatgcttgctgcgttggacttgccatggtccgcttaacataacccacactcctctgcaggagccaaaatcatcaggtgcagtttggaaaggcattcaagctgccatagctatcttgcaagctacctcactagagattgaattaataaagctctcaccataccatcacttgcctttattctcctggggcaattgcttcctctttgaatcctttgcttctggatgcttgtccccttctttgaggaatccaaaacttgcttttttttcccatctatgaaggaaacccaatgaattagctaatgggctctccaattttccagctacagtgaaaaattggaattttaatttcgttccagaactcatattacttgtaagcactaacgataatgttgttttcttctgaaggattgtgaataatattatttagggttctggccttgggccaaaacaggagagacaagagctcacattttaggtaaaacatacaaagttattgattcaaaaaaatatggcctgagttgaaatcaagcggagtgcgtatgggaacccaatcatggactagttcttgtcgcattgattagatcccctctgttagatgacaagaattcctcatttcgaaggttggatgatgcattctcaaaatctagtctagaataattgaagtattggcaaagatattggcatagagagagactaacccgacagatcccacaattaaaatataaattattttctaagaaacgttgatctaaatatacatgaaattatagagatgcaaatgcaaaactttaagtttcttaatacaaaaaagttaagttctattacttttgattgattttatatcttgcactgatagcagatctaatctatccaatttattacttctagcagcataaaattgatttatgatttttgaacctatgcatattggactttatgatttgccgtatccattgtcaccccaagcttctcattgtcttttattttttttatttagtttatttagtagtattgctttccctcccataaaaaataaataaataaataactaagtaaatgaagcttcgagggccattttttgtgagaaagttgaactctcctaatataaagttgcaagatgccacggtttatctacattttcacacattaatgatgaaaggaacttcgtgggatcctcatgttttaaagagaagtgaaagagagtcccaggacatatggtctctgatttctgaataggtagaaacatggatttctcacacaaaatacaattctctcacatacattttgttggaattacatggtatttcaaaaggtatgaagttcacgtcagccctatacctatttctagtttgttcttgatttttagctgatttttttgatcgtgttaactattctgttaaagatttgcttttacatgattctagccagattttcaaccactttaccaacgtcctctcacctaaatggcctaaaaatattactccacttaaccctcttgaaaaccaaccaacaaatttttcttcccaactttttctccatgacaaacagcttttattcatatatcttttcacctggttgctgtctcgttgttaaaaaaaaaaagaaaatacttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgctgtctcgttgttaaaaaaaaaaaatcttcactttaagtttttcttgctaggtttattcttatctttatttctgttacttctgcttcctcacttatgagtgcacactattgagaaggcctgttgtatcctgagggatagccgtcaaaataccttctgcacctaagaaggatggaatctatcctttaggatagtgtttcacacctcaagcaaaaatcgtagttacaatcctaccttttgccttttcctacaatctaaaggatagaaatggatcccactactactagtaccattgccgctagttcctccaatgctacatccactgttgttgcaatgtctgccataccgttgcttcctaccatacctctcactgcacatgaggggtttccagacacctccaaaattgatgtgttttgtggcaacaactttagaagatggcaagagcgcatcctctcagctcttgacatgtacaatattgattttgctctaactcaaacaaagtctgaagaagaaacacctgactataccagcaatatagagaactggaggcatgcaaataagacgttggccaacaaagatttgcgatagagaattatgcttactggcatatgattgaagataaggatatcaagatgcagatcaacgagtaccacaagctgatagacgacttgaagtccgaaaacatagagctgtcagaaagttttatagctggcatgctgatcgaaaagctgcccaactcgtggagcgactacaagcaacaactcaagcacaagtacaaggagatgtcgttggaagatttgattgtgcacatcatcatcgaagataggaatataaagcaagtggaggctgtaaggaccaaggaggtgatctcgaaagccaacttgatgcaagacaagtcgaataagcataaaaggtatggacactctaaaactaattataaacccaaatctaataattgtaccttcaaaaagaagggatattgttttgtttgtggcaagccaaagcaccatgcacctcaatgcaggaagagagtgagacatgacaatccggttaagccaaatgcaaatttggttcaaatagatgataatgacattattgctgcggccatttttcaagtgaacatgatagcaactttgaaagattgggtggtagactctggtgccaccaggcatatctgtgcaaacagaaatgcctttatctcctacacaccagtaggggaaggagaagaaactatttacttaggtaactcaaaatctacacaagttcttggaaaaagaaaagttcttctcaagctcacctcaggcaagatattggcattgaatgaagtgctccatgttcctactataagagcaaacctattttttgtggccctactggaaaagattggggaaaaagtgtcacttgaatttgacaagatagtaatgacaaagaataattttttttgggtaagggatattctaaccagagactctttgtactttatattgttgaagtaattaatgaaaatgcatgtacttcttctgttgatatgcttaatgatgttaatttgtggcatggtagacttgggcatgttagtatatcatatattaagaaaatgcaatctttaggattaatttctgacattgataatgcttgcatgaacaagtgtggaatttatgctgaaaccaaaacaactagaaaaacttatgcatttgtggaaagagaatctaaacttttaggattaattcatactgatttaggtgatttaaaacaaactatgactagaggtggaaagagatattatatcacttttattgatgattattctaggtatactgagatttatttattgaggaataaagatgaggcctttagtatgtttctattatataaagttgaagtagaaaatcaattaagtaaaaagattaaaagagttagatcagatagaggtggggaatatattttgtttaatgatttttgtgagaaggaaggtataattcatgaggttacacctccttattcccctgaatcaaacggagtagcaaaaagaaaaaatagaacactaaaaaaaatgatgaactctatgcttgttagttcacatgcacctgataatctttggggtgaagccatcttatctatatgtcatattcaaaataggattccatataaaaacaccgataagataccttttgaattgtggaagggttatacccctaacttgaaatatttgaaattgtgggggtatcttgctaaagtgttgttacctgaacctaagaaaagaaaaataggatctaaaacttcagattgcatgtttattggatatactgatcatagtgcagcatataagtttcttgttttgaaaaatggcatgcttgagtgtaactctatagttgaaacaaagaatgcggaattctttgaaaatatattttctttaaaatctgagaaaataactcctgggctttttgaaaatgttggttttggaaactcagatttaggtttgagaaggagcaaaaaacctaaaaaaaaattatttagaaatgatttttgtatctattttattgataaagatcctgtgtctttttctgaagctatctccttccctgatagtcatttttggaaagaagctatcaaaaatgaacttgattcaatttcacataatcaaacttaagaactagttgatttacctcttggagcaaaacctattggatgtaaatgaatttaaaaaaaaattaatcctgatgattctattgataaatacaaagctagacttattaccaagggttttaatcaaaaatcaaatgtggactattttgatacttttgcaccagtgatcagaatttcttcaattcgaattttgatcgctttagcttctatttataatcttgttttttatcaaatggatgtcaaaattatttttctaaatggtgatttagaaaaaaaaattatatggttcaaccagagggttgtgttgtttctggtaatgaaaacaaaatgtgcaaattgagaaaatctttatatagtttaaaacaagctccaaaacaatgacataagaaatttgatagagttttaatggatatcagattttcttctattggagtagataaatgtgtgtacaccaagactattgataatgactgtgtgattatcaatttgtatgtggatgacatgctcatttttggaactgatctcaaaattgtgaaagaaacaaaaggttttttagcctcccaatttgacatgaaagatatgggagaagccaatatgattttaggtgttaaaatcataagagatatgaatggcttgatattgacacaagaacattatgttgagaggctacttaaaaggtttggtcattttgatgacacacctgtttgtactccttatgatgctaatactcaattaaaaaagaagagaggtgatagtgtggctcagtctcaatatgctcagattattaaaagtctgatgcatttaatgaactatacatgacctgatatagcttatgcagtgtgtagattgagcagatatactcaaaatcccaatcgtaatcattggactactttagtcagactaatgagatatttaataggtaccataaactatgatattttgtatagtagattttttactgtattagaaggatacaacgatgctaattggatctccgattcagataagacaaaattcactagtggatatgtgtttactcttggtgggggtgcaataacttgaaaatcagctaaacaaactatcattgctaaatctatcatggaatcagagtttgtagcctttgagttggctggaaatgagactgagtggttgaaaaacttcttagcagatatttcattgggtataaaaccaacaccttctgtgtctatgcattgtcactactaggctgcaatagccattgcgaaaaataaaacatataatggtaaaaataagcacattcatttaagacatgatatagtaaagcggctgcttaaggatggaattatatccatcgattatgtgaagtcagagatgaatttagccgatcctctgcctaaacctttgggcagaaaattcataaatgaaacatcgagaggaataggactaaagctgactttaagaaatcaacaatgatggtaacccaacttatgtgattggtgatcctatgaagtagattcatataggtaataacaagtcatttgttgatcaagaaaagtactataaatactattttcctttctgtggtgtgcataatgcaaactgtaattaataagaggttgagttaagctcttaatgaattctatatcccttatgagtggtgtattgaattacagtgtacacttgatggaatcacttatatatatgagtgcgaagtggggtcgcttctgtaagattctttgacaagatctctagagcactcacgaataaccaggcatgcgcatggcctattagcacaattccgcgatgagtagcaaaaattgtaggagtgtagtgtgattggtgaaacttataatttactctaagattttttttagttcataaaagttataaacttcaccaataatcctacaaattataactcattctttctaggactgattcatagctcaaaaggcaccaatttcgatgcattacactcagttgagttaacccagcatttgtttggtgatattatttgccttttgaaatatgtgggggatgttggaattacgtagtatttcaaaaggcatgaagatcaggtcagccctataactgtttctagtttattcctagttttcagctgatttttttggtcgtatttattattttgttaaagatttactttcatctgattctagtcagattttcagctattttaccaacatcctctcacctaaatggcctaaaaatactatcccacttagccctcttgaaaaccaaccagcagatttttctccccaactttttctcaacaacaaatagcttttatttatatatcttttcacctgtttgctgtctcattgtaaaaaaaaaaaaacttcacttcaaatttttcttgctgggtttattcttatctttatttctgctactcttgcttcctcacttgtgagtgcatataattgagaaggcctattgtattcttggggatagccgtcaaaataccttctgcatctaagaagaacagatctatcctttaggacagtatttcataccttaagcaaacaccgtagttacaatcctacctcttatctttttctacacatttcacgtactcaaaacttatccaacattcactcgagatttttctatccttccaaaaaaaaaatacgattctcctcagaaaaaaagtcctctatgatttgtcttctgcaccacattgcagtggcatcattgataaccatcatgtcatccatcttagacatagatggctctccttcgttaccacgacatgccttatattatggcaacaatacttcgtcatatttcaaaaacaggtaaaagctatccatctttgaaatagattttgtggtagctatcaataatgttaccgtacttaatgatgtgaaagttgcatcacagagaatccgaacacttgtcttagtccactcggctttgctgattcagctttctctgattggtccccatatgccaatcggatgaactcatcatccttgccacatgaaccatgcttcatccaacagtggccaagtggtcctgccttcatctattcccatgtcagcaagaaaagtggccaccagcggacaaccaacaaccttgacggttcacctacgttgcctccttttaagtggtcggcattcgttttaaacggtcgaaaacttgaaattgtgagttcccttaaatgcccccaaaaatagctgtttgttgttgtaggttttcttgttcccatgtacaaattccaggtttgaggggttatctcacctaattgaccaaagcttattagctttagctaagggtgatacagtctatgtgaagatggattccatggtcaattacttgtgaagaccagaaggcttaggtcaccaaactgatatgaaaacttagttgcaaatctttgaatcatattctaattgattccagtttcttcagtccaaaacaaagtgtaccccggaagcgacttagcttagctacataaagattttgaccaatggtgcgtacatcgaaagcttctgtacctataaagtacagctgaccagatggtaatataaggtcgaaaatttagatatgtttgattttgatgcaatattgaccgttgaaatatgatctgaattcaaagctttggatgctgtgattccaagtccacccatttagagttgattattgcttaaaattgcggctgtgttgtcatcatcttcattatggaattcatgagaatgttatgggaatgcataattatattcataataaaataacactatttgtgtcataactgattttcacatgcaaatatcatgaattatatatagatagctggggaagaaatgaaagaattagttttttgtttttcttttttttttttttctcttgagaaaaaggagctgccattttgtttcaaatatttgctccacgctttcaaagtttatgtggtcctcctaatcaaaaactatacaggttctgctaggtatcgggaaaaaggggttctcggaatacacccaaattgtagaacatgtattggttgcaaaatgaaattatgacatagtcatatgtaaataagctgtaatcaagaacgatattttacataaagcatgagtaaatacatgtggttaagtcataatttatgcaccaatgacaaaaaattagggttgaaaattgtgttggttgtgaaaattgcataagctagaatatgtatacaggcattttatgtgtaacttcaacattaaaattatttcacggcaattttcttagatggttatcaataattagaacctcatttttgcaatatatattgatggcaaaattacactttaatagttagatcaaagtataaaaataaaattgataacgtatcaataacctgagtttatctataccaaatgctaagaatagctcgcaacctttgctaaatcattcattactcgtaaaaatctagccttcatctattttcttgaatattagatttttttcacattcacatgttccacatcaagaaggggattgtggattctctacattcttgtctaaaccggttcctattaacatcatatacctttttcaatttactagcataaatgtggttaggcaacattcaagatgcacatacatcatcatcatgtgcacatataagagctatcaactatttaagcatgcaaaccaatgccatggttctccaaaagagattatatatatataaaaaaaaaagttttaaattttaagcttgcactgtggtcattaggtggttggactgccccactcacacggctcttagatgctaacgtgcaccaagccagcagcggcaccacctccacaaatggaactcaccatcaaatgacaaaaataatcccatattttctattaaattccaacggtccaaacagtatataaccaacgaagccccgtcgctcgctcgctctctcgctctctccgcccccaactgttcgatcatttcgatggctccgatccaattgaagcaatcgccgagttccgcgcaaaccctaacgcggggcggggcgacggaggcgagggcggtggtcagggaggcgatgcgaaccaccgccgctgcaacggtcgctgcgccgcctgtcgtgccttctctgcctccgcctccggcggatcagatcttgacggaggtgaggtttgggccggccgtggatgggctcgcggtgaatgccgcagcggcctcgtcgaggatcttgtgctgcgaggagatcgatgggcggaggtggaattatgtggtggatgtggaagggaccgggagcgtccggaggtgttcgtcggccgtgaaggcggtttcgttgcagacaccggtggcgcctgtggaggtgagttggtttttattagctttggagttgtctaatatcaaaaaaattatcattgtttttgtttcaatacttggtcttttaacttttatgcccataatcttaatcgctacttagttaattttaattcatattaagaagatatctcgaaagctatggttttttaggtggcattaatcttaactgatgttcttctggcaattacttcaatagattatgtcaatgtcttttttcttttttttttttgaaaattaatattttttgctgcttactaggtaatcctggctcttccttctcgaaatttattttttgtatcacattattttctgttggaaaattagaaagaaagaaaaagttcctgtttcattctttttttacgacaaactttgcaaccgttttgttcttactgatctggacaaaaagcttttgagtttttgttttataaaggagccgtgcgtgcaatctcaaaatggatgttggattcagaatgaaagattcttcaatttttgagtaagttttgtgtggcccttagttgcatgcttggtgcgttagataaatgcctgagaacaaagaatacagcaaagtactgaagacattgctaatgaaaactaggggattggctgcagatgaagaatttcatgggaatatttaactgataggccaaacattaatgagtttgataatgcataatatattaaaaaaataaagtgaagtgtcaacagattttggatgatatttgtcaaaagaatttgccaggggatttagtttagtcttcactgctgcgttattttgcatatggccagaactgagacacaaaggaaagagtgaaaaatcaaatttaagcatgaatccctcctgcgtgctctatttttgcctgcctcttttcagtacatgtaacaaattttgagatctagtaatatttgtcatactgccttgagttttatcattctcatcccaaaatgactgtctggaaagggcatattaattataaagtagctattggtaccaggactttgaaatatatcattttttgataggatgctttttggatgggcagtttacatctctaagaactttacacctttcatttctctactctgcattttcatgtagtacgcttgtaactgcatctagcaaaagtatggaacacatgtttttggttttctatttcttggcaatttaagaatggagacctacagcattcagctacaatataatcacagataggaattctggtgcaggaattgatctcattcataagatcttatgtagtgcctgaagggtttccagatagtgttaccccttcatacgttccatacatgacatggcgagctttgaaggtatttacttgaaccagcacttggcttcaattcataagctatttagttatttcaatctgttaatgcatgcttgtgctacaacctctaacaagaaatttttctttattttgaactctctcatgatatactaataattattatcattgttcagcatttctttggtggagctatgggtgttttcacaacacagacactgttgagttctgttggagtatctagaaatagagccacaccaggtgctgttgctattaattggatacttaaggtaaagaatatcagcatgtcctagcagggaaaacactgactataatgttatgtttcattcataaagtaacttctgcattctcttgtagaaaaccattaagttcatcttttacttgctctatttttctagtagaatcactactattgtctatatcagcaagctaaggtgctgctatgctacatatattgcttatcaaaaaagaaaaaaaaataatctagtgtacatgcaacgacagaaagacaaggatcttgtatttgaagtctttcacaatttgttagtgctatacagacacacagatgcacatacacacctgtaaggacgcatagctctattacaactgaagggagctagttttcaacttgtttagtcttgtgagagcaaatttctattaatttgtctatttttttttttagtttcattaatttaacaatttaatgcatattttacgtcacctactggacccaaattgttaaataagcatcaaggggtcactgtttaaagaaaaaatgattcaaactagagattctgtttctttctaaaattcagatattggacatttatctgttattgactgagactgaccaatctttagatgttcgttttccatattggctttaatggctgatgaaactgtcttggattacctgtggaactgttcaatggtccactagcttggggcttaggacttctgacaagctgtatccctgaattagattgataaatattccaaagtggtggatgcagtgtatggtccaccaactgctctttaagttagtagaaggtcatgcattccatgcacgggttaagtgggatccatgtgttatgtgcaattctgcatctaggatgctataagctcatcctcaatatgagtttgctagaaaacaaaatattttgtcgctaacatagaaatcaggactgaagtgttgctccaaccaagatgtttgtgtatgtcaaaagatatgcatgtaagtttttgtagagtctagatatctgactgaacaacctaatttccaagtaagtttggtttagatgtaaggtccaagatacccttggatcaaggctgggtaggtctcaatcaaaagttttccaatcacaaattggcttccagttaggcatccaacacaactaggaagacacagtacaaaacttgagaacttgagaatttaacaactgcaacatctctaaatcagcaggtagtttgtctcagaattgtaagttgttcatggtgaccgacttaaaaacaagattcattgatttgtggaacaaaggaggatggagaaaaaggagagagatcattgccttatttcaaattttgaagaaaaatgcctgaataaagtagtattcttcacctttatcttggagaaggttgcttaagaatcgccttaggaatcccatgtctttggatcttacattcaaagaggtaccaacttgatatttaacaaatattccatataaatgttcattgttggactatggcagaggcagttcataaatgtcttggacagtaagcatccatcatccatggatattggtttttagaactggactggactggccagtcaaaccagtagattgacaagctggctcttgatgcactttgggcttaagtttgaacttcggatcatgaaaatcaggtgatctggctggatttttgctcagctcaactgacttgattgagttataatgacctaaatttcccttcctctttctttaaaaaagcccaaaaaaccataacaaatggagacttgaacatccaacctgctgtaaatgttggaagctccttcaccagcacaacccagaatctgccttgacatataatgatgataatatatgatacatatattataaaatagtaaattagaaagattcaccacatgacacaaaatttcattaagccaaacaatagcacttagccctgatattttaataattaatatttggcccttggttttaccattgaatgtctggatcacaaagggttacgttttatgaacatttttctttgaaagcttcctgagcattatttttactaaattttagcagtccgatgcacatgcatgcatgtagatgactctgatttttaagaaaaaataaattttagaaagcacattcaatttttaaaatatttctttaaaaataatatatttataatactattttgcccatgaacctatctagtcttagatgattatttttaattgaaaagtgctttggatatgtgaaaattctaaataaagaaagaaagtcaaaaagatgtcaaggaaataagacttttcttttcctgcgggttgtgggtcctgggtgcccataaggaagaaaggtagagagcactttatttcagggcacaagggaaagaaaagagatcgagtattataattttattatactttttgagaagtgtaatgtatggctgcaggctttgcggctggccttaaggattttttccattatatagtagatttttatagtattttatcatatatttttattggatcaccaattgaaccaatgattgattggttggactggtaaccaaggacttgttcttcttgctcgtttgatatccagtctgggcttgataaatgttaactattgacatgtaggctagggctcatgaaccaaaatcatatcacgtagctggcacatgactgcccattggttatgttctcattcttttgagagtgttaagactcactcctacatgcacatccttgcaagttacttgggatactggttgataatgatgtttgcatgtgtgtcttgattatcatgtgcaagagcctgtgaactatacatgcatgcaagtgctgcttgcagttatgtttgcttgctccccctgctacttgctcctgcactgcagatgagctgctttgtctgcttacacatgcatgtgttggtgtgcttggagcactttttaaagttcattctgactctgagtgtcaaatttactcctgcaactaagaataaaaaatcattggttgcaatcgtgaagaaatattttactagaaactataattcacaatgtgtaacacatccgttgggagtcataagatgtaggagagccccacatatgctctatggggtaaggttgatggaaggctgtcagaataaatgcatgtaatgtctggatacctaataacaaagaaaacatgaagatatggagatgaacaaatactctctggagttttgtctgatagtaaagtagatgaatccttctagtagttgtcaccttgaagttacaaagtattgcaagccatcaatgataaaaaaattatgttaattaatttattgttaatgatatttttcttttttcatggctacagaatttaattttctttttcactttaaatttaaattttgttccagtatagctattcatagtttcaaatggtattgagataatcaggtttcatggtttgcaaaaatctttggctctaaaatgccacatcaggacacattctggttgcttaacttattatgcttttaatcttttattgttgccattatattttttttgttttgttttaagttgttgccattgattttcaagtatcagcggccaaattctgtggtttcttatgattctgaccgtgcatggaaaatatgcaggatggagctgggcgtgttggcaaaatgctttttgcacggcaaggaaagaagtttgactatgatctaaagcaggtaaagcacaagcacatattaatctctctacacctctattcatagaagaacgttattcttaaatcttgttgttgattggcccagcttcgctttgcgggtgatcttttaatggaattgggtgctggggtagaattagcaacttctgctgttccacagcttttcttaccattggcttgtgcagccaatgtggcaaaggttgaacttgttcttacacaatcagatcttttccattgaagttatatgaatggaggttattcatgaagcatatctcttgacaatctccccatgcagaacgttgctgctgtgacttcgacatcaacacgcactccaatctacaaggcctatgcaaaaggagaaaatattggtgatgtcactgctaaaggagaatgtgttggcaatattgcagatctggtatgctatcctgctttctgcctacatattgttgctttaaagtattaatcattagtatattaaatgtctaggagtatgaaagggtttacaagacctgatccgagtaaatattttggcaatattacttatgtgacagctaatctcggacctgctttgtattccaaaattacaaatagcaatttaaatttaacatgaccctagagtcataaaaggatattataagatttctatggtatttttttcattggtaaaacgtttggtcaacagatgccatccaatgaaacaatattaggcacaaccagtggagagtcagaacttgaagggcctctttggctacaactgcaggcataggttgggattggacagctggaactgggtgaagggagggagggagaaggagaggaagaagggagagcatggggtgttgggcaggctcctcccactctcccagtccctcccttccttccctgttgttttctttctccagctgatcttgccagatccagcaggaagttcccagagaggccctaatacttttgcagtgcagcagtaactatctccctttcctatatattggacttctaggaaacacataatcacattgctgtctttcaaaatgtgcatattctcttcctccaacacactgcaagctccatatttcgagctctctctttcttaagatgctattgtcaagcacaaagtccttccagctttgatatgccataacaactccatttcaaaagcagactgacctttcatcggataattagcacttttgcttcttcaaaatcaacatctttatagtaccaataaaggactccagattcataaggaggtctcataggtgaagccccataatgccagtcatctctaaagccctttagcatccacgatagagtgtgagaggtccctgacagagattcctcgaaaactgatcatcctttcatgtgcatttgatgaattcatcccacatttccagatattgttgaccattttttcttccacaagattctcagaataaagcaaataaacaaagtacaaactattgcttgactctgaggaatgccatgttaggcaaggtctgaactccatcggagatcacaatattcagcctctgagcttcaccagagaacaaactgtttaggtttatatagattggatgaaaaccatgtgaattaagattttattccttgccataaatggtgcaaaacgcagcatcaactaggatacatagaggaggttagaggtcttttaactgtaaaatgatgacttccgtagatttcacacaagttttgaaaagtgcaacatagtgagttacagatttgcaaggcttgaataagaagaatgttgcctcctatgctttaatgatttcaatttatgtttgttctgcataacaagccaacaaggccctaaaaatttatataggagccacagattgcacatattgctctagaggaacattaacagatattctgagaaaagttttagctaaagttctgaatactttgttgaacaaaaccagcttatctaacttgtttctagggttaaaattcttgcttatgagattagcttaatttatagatgttcatataagtagagggctgtatgggtgaattccattagtttgtaatgataaagaattggccattgaccaaaaacatagagatctgatttggtttctttgttggggttatagcataactccataatgttgcccaagttgtcttttaaaccgatttccacaatattgttcataaactttagataacttctaaaatcaattttctttcatacatttgtttattgcatttatatgtatcttgttataattctaatcacaatttcatcttgaacttcttgtcttgaagttggggactggaatgagtatcttgatttcaaaaagaaacccatccttgcttgcttcatttgctttcctgtcatgtggatatatccttagttcatatcaggaggtatgggtctttaattctatgattaaattctgtatttttgttattatttgttaatgttctgacagaatcttctgttcaattaatatttactttgtcaggtcaagtcagttgttttgaacactctaaatagggcaagattcaccgtggcggtggaatctttcattaagactggtaggtcaagtcagtcttctgatatgcatattgactctatcgagctgtagtgagcatattgtagtgtagtggttctagctggtgggatgctaattggtatagtcccacattgtgagcctcaagatataggttgttcttgccataccaaaagtcaaaacatgtcttttgatatggcatggtacaacacaatacttaatattctgctctagcaatggctgttttaccaaggtggctgtacgagcaatgatagatatgttttggatggacccagaagagctatttttgatggtttaattatgaatgatagaaatgattggaaaatacatgtacagcaaaattaaagaaatacaaaaaccaatattatcttcaatatgcatgtttgtgtaacttatacttgaaaatacattatagcaacagctttagtttatcagcataaggggagaaaggtttatggtactaataaaacatgaagctgcaaagcacatggtgctataagataaagacatgtattaagacacagtttcatagcatgattatcctaaaaaattcatcaaatgaaatgtacacaatacaatgaaaggataagaagttattatgtaacatagtgccaaactgaatgtctataacggtcacacatggttgttacagagtccctgacatccatgatatatatgactagtaaatcaggttttagtggcttgtttctttcttggttgtaaacttaaaattgttggccttattgactcaatttaattttgagtggtaatggaaaaaatatggggagaaaaagagcagttttgaaggctgacaaacaaatttagtttcaggtatcttgatactaggattgtcaaatcacgatttatttacacatcatggcatgctgctgtaatgagttatatttctctttgtattgattgataaaatttgatatgttgatccaagatacaatagggcatgtagcatattagagaaacagcagataacggcttgtgtgacatgatattaaatgataattggaatttggtcaaccatagacttgcttacaagaaataccatttattcctaaaatgccttgatgtgtgagcatttaagttcatcatatttcagcacattgcattccttcccaacttatgttgaaactgggatctctacttgaagtgggttttgccaaaatcctgtgtataggatgttaaaacaccaatatttctgttaaaacaccaaaatcctctatatatagaacttggaacctctccttgtgcatgccttcaggaaggggtgccaaccagcttctctatgtgatacctattattttgtgttctaaaatcatctcaaacttctctatactagataaatttgatttgacatatgccactgctaattgttcaatccttataattttgcagggcaagttccctcactgaaggaagggaattcaaaggaaaatatattcagtcctccatggttaaaacatacacctgtcattctaggttgacatgatatcccaatcattttgtttttaatttttttatgtgagtaattttgcacagctgcagaaggctaaacttataggtctggtttgagtctcttcaggtcctacatttggggatgcatttcaggatcctgcttcatttcttgccacgcagtgcttgtttgaggtataatttccaaccttgtttacatggtggtttttggatgcacttgtagtttgcttacttctattattctgtatattgtgcaacttacattactgaacattgtcatccttgaaataactttttcttttccccttaccatgctgcattaggtgtgagctgaaatattcttgcatatttgctaatataatttatctcccgttacagaaagaaagatatatggtcacctataacccttcaaaggataaaatttatgcattgcttaaggatcaagcaaagtctgatgatattttgaaagcagctttccatgtgagtatggattcttaattttaagtaatttaggacatatctgctttaacctcttctaattcagattaatgtatcttgtattacaggctcatgttctattatattttgttcgtttatcaaatgtcaatcgatctctgagaaaccgcaataagtacgatcaatcaaaactagaatccccaattcctacaaactctgactttgtggctcatgttgcggagtcctgcaagattgtttcatcttcatatggggttttcaagaggaaggcagcagaacaggtgacatgttggctacttggctatcagaagctttagatgcatgttaacattaagggccattaaacatactctgagatgtgtttaaacacacacacacacacagaaacacatacatatatatgcaagtacgtagtaaaaaatagatcacaattagagttattgcttatgtataatcactgtttactatcataaactcactggatttgttaattcagttatttgcctgggacttatacgtgacttagatgattttgtaagttttaacattcatgtcagttaaaatcaaatgaagtaaacttagaagtccggaagaggaaattaaatccattatccaaacagaaaaaaggatattgttaaagaaatagtaacaaaatatttccagtattttattggaaaagactgccatggttttataaattttgacctttggctgggcaagtgcctttcatcttatagatggttagcgtatgtggttttctcattttgatgtctcgggaaatgtggaagctattagaaaagctggtggttaggtggatctagcctgtagtaataggataaatgaggctatgaaagttcagatatctgatatatggtggatgatgtgtcatgcaagtttgcatctattagcgagaggaaagatgaccagcaagtatatccatgtgtgatgaggaatataaaacagctgtacagagtcattctgcatattataacaccaacatgcatggctaagaaactcacaggcagggtgcctgtgttgcttaaccttttaatttagtgcagctgcttctcattcctctggattgacctctctatgactgacatttttttttcctggttggtgaagagaactggcttttattattatgctcacaaccggctcctttcttgcagggatggataatgtcagactcattgcttaaccctggacgagctcggctttgtgaacttaaagagcaataattttctgaccatctcagttcataatatttatgagacctcatttcttggtctgttgattttagaatatgcagttgagaccgaatggcaaatatggttattccatgttatttcatactgtaaaccagcactcattactcagacagcagatatggcttctccaaaattattcctaaagttcacaccatactgcaacactctagtcttccaagattttactcattagactttgttgatctatcccatcatgaaatggctgcagttttttttttggttagcttcaactgacccttcctacaagcaatgaagcatgatttactgactaccagtttgtacaataagtttctagagttaaccagttggcacagtcaatggagagtactgcttgtaagcctttttctcctgacattgtaggccttttcttgtagattagtttttttgtattttgtccatctcaatgggtttttttgtctatttatctttcaggaaaaaattgactgggtgcagggcaatgtaaaatagttggcgaaagctaaatggaagagcaaatagagctttcccggtggcatgaatgtattacataggcaggctgtgacttttctcttcgttttcttttttccttttcctttttttcattcaatctgtatcatacttcaacttatattcagttatttgtaagtgggcttcattaatagaatacaatgtttggcttcctgatatttacattttttttccttaaaaaaatttggttgcagacttttttggcccttgttataatttaatgatttcacttcttgatgtaaaagcatctttttactctagaaagcagagttattcattgatttgtcaaaattatccatcatgttcatatcattgatgtgcaaatagagactaattaattgagatctctaaaagagaatgtgaagtttcaaaattctaacattcagctttctgtgtaaagttcttcgatctgtatactagtgaaaagaaaagttccaagttttccccaaaacctccccattgagattcatgttgaaatgttcatatccttcatacccatcaaatgacagcacattgttatccctcttgacatcagaaatgcagcaacctaggacttatcttctggcatgtggaacctagggctggtcattcctccctcactactttttgctttggagcttagcctcggcctagttgatcagttgcaaggggttaacccctggttagattaggaagctccaatgtggagatgggactcttcaggtcatcttctttgggagtctcttaggcctgcttgcttccaccatttgacatggcatgttcacttgtttctcaggaaggaaaaattgcataccaggaaaatcttggcaaggaaaggctgaagcctgcctaggggtcatattttctacctagctatttgaagagaagataaagcatatgctctcctgcaaagttgcccaggaatgggaacctttcttcggaactcgaagtctaatcttgtcattaaacaaggattttatgtttgtaccattaaaacacaaggatttatgtaagaccaattagagatgcctacaatgcgcgaaggaacctaaggatgcgaaaggttgagggctatcttggtgttgccacttataatttagaaggcttaaaacttactaattagaaattcatgaaacaagcattagctttgtggctagaccccatcatttcaaagcaagggttcgggtgtttgagtcttgtgctgttatcccctaacgattcgattctactagggtttcctgcagtaaaatcctgggtttttatttgatctcggatagacccagatacttgcttttctcttacacatgcgacttccctcccctatctcaaaaaataaaaataaaaataaaaattatccgatttccttaccatgttatggagtcttgaaaattgattggtctttcaataatcgaacaatttctttactttaattatggtttgatagaatgggttctaaaccatcacactttggatatagctgataaaacaagaagatatgcagatgattttgagacattgcctgatgctaatggattaggatattttgtttcaagagaacctggatccttcggttcggttcgggaaaagctgcttcatgttcttgccagattctctatcagtcacatatgtcaagttttgtcagcataagctagcgtgtggagtacccaacaagcatatcatttgatatgtttcgagtgtttttgtactgagggtcaagtagaattttgaatataacatttacgagggaatctaaggtggatttcttggatgttcaaagaggcaaaaaaaacaaaaaagtataattccaggaaaatgcaagttattcaattggttatgttatcaccggaagatccctgcggtcgacactttagcaaaaaaaaatttccacgattttagccgatgccaattctgttacagcaattgtgaagttttggatcactatgttgcattgcagctactcgacagaagtttggaagaatatcttatggagatacaatattacagatcttccatgagatataaaaactttctgggatgaatggagacaacgacagaggatctcaaataaatttagatgattggatatcattatatcaatcactctatagttcctatgatcagagagaaataataggctattccgttcaacagctcgctcacccagcgaattagcaagaaccgcggtcttcctagcagcagactggatcaaaaactcatatacagtaactcacaaactgtagttttagagctcaatcctgaggcgatatatatgcctttgatcctttttgaagactctggaaaagatacacatcttgagccgggatctactgggctgctctaccctcaaaaaaattttgaaaatagttttgcttttctaccgttgctggacactcagtgaactccggaatcaaaatatttcgaaatacctctcccaccttttcaaaaaccaactcactgaacattacttctgatgggacaaaaagtttggaatcagcccttagtatatttttttttgttcctccacccaccgtcattgggatttctccatgcattttgttctccatttgacccatctaaacattcacaagtcatgtagtgaccataatacctccacaggttgtaattcacattgatataatactaattgcaagggagaaccactcacttcctccttatgttacctcaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccttatgttacctcaaaaaaaaaagtataattccatcaagatgtggactccctacatgtcctcttttcagctctcaaccattcctgtgttctgtcggtcttccattggcaatggctggaaaatattactagctatgatgaactaaattgttcccttatgacagtttaccatctggtccagatgacttccatttctttcatagtttcctccttttattgtgatggaagtgctctcgtcattttctatctggcattttacgattgttccccattttccccataaaagagggaagaaagagatggcaaaaacgtgaacatgctttcagaaaatagcaccaacgacagcagaaacagtttcttgtcaaaataagatcgaccatgaagaaagactaaagttgggagactctagaaaagatggttcattacatgtggccaaacctgactggttttaagaattcataacatacatggaagggaaatatggttgatacttgacagagacaaaataaatctcatatttgaattgaaatgtggacaattaatttatgagagagaaaattcccaattattcttgagaaagaatactacatgaagtggttcagtgtttaacaagctgtgagctctctgttacagtgaaataccaaacatatttagttttggtgcactatgtgtgagttctgttggtatttttcactcagtatccacacaatcagaacatcttcctcccctctattaaaccttccagcacaattcatcacataatagatatagctgcacagcccatcactggcagttaggaacaagtaaagatcatggaaacatcaattaatacttgctcttacctttgaatccaagtctgatttctatctattgacaccttccaaggtgaagaactgcatttgcggtcaagaggttggttaagaggttggatggatcggatggctgagttgactctgcgtctgtgtacgtaagatattgcccgttttgactcgatcatctttgggattcagtgagcatctttgggattcagtgagcctcacggttttgtcctttaaaaaacatctcatgtgagagagaagattccaatccatgtaagtcatactccctcttgactcacaaccgatgtgggactaaagataccggcctcccgcaatattactctcctcccccccaaatcaagggagagtatatgtgcatgggtaggaggcaatcccacagacggcaccaaagttatggtttgcgaccccccctcccgtcaagggggagtatgtgtgcataggtagaaggcaatcccatggacggcaccaaggttgcggtttgcaaggatcggatggttgggttgactccgcacccgcatacatgagatattatccgctttggttctgactatcttagaacttcagtgggtcttggccatttgaagcctcatgattttactctttaaaagacgtctcatgtaggagagaaggtttcaatccatataagctatatttcctatttactcacaatcgatgtgggactaaagatgctgtcctcgtacaatagtatattcttcatgccttggactataaattaataaaatgtgatgcaattccaaaactgggcaaacacctctcatgtgcagaaagccttcaacttagcttgctctccacataacagtggtaagtaatagcagtgcttctaccaaccataataacatcaatcggatggtcttgttggatcctgtgttctccacccattgtccctgaatgctatcagaagcaggccctacctcttgtccaactctggggtggtctttgatgggtgtccatcactggcgtaggctgctacaatgaggctttcacggtaggctgttctttgtgagacatgcagtacttaatgcattcaagatattattgtttaccaaacatggatatggtctgtgcaagatccaagtagtgggcctcacatctcacaagccaaccatatgtttaggttagtacactggcaagtgggctctacatattgattgtttctactatgtgaagactctggcttgtagcaccttcagaacaaaagacagtcttgccttttaagtatttttgagttcagtgggaaaagagaatgataatatttacataaatgtacttgcatacagatatcatatgaatctctctctcccttacacactttactaagtctctctctttttttttcctttttttttcccggagactgaaccatttcctttcaaaatcaaacccttgctacctaccatggaggttaagcctcccgcttcaaatcaagggcaccccatttccttgtgtttttatgttctaattccttctggtagctgctatttggtctcatagtattgaggctaaaattcatatttctctgttaatggttagtttcaattaacttgattccattcttttcagattccaacattttgttaattcatccacttctgattttgaactttttgagagctgtgagctattactgtttttggttgctgtaagagaaggctgaagaaatagagcaatataagatgacaaggcgaggaaaaaaaaaagaacttggaatattctactgaaactaaatatttttgtgaggagctacttagattaaaagaattggatgtttttattaaaaatgttgtatgcaaccaaatcccaagcattacaaaaccaacttgtaatttaaaaagcatgttcactcaagagatatcatgattttgtggttcatctgaaggaattgttctggtaattgggtaaaccattaccgacgaagcactgttaccattttaagataaagatggagttctttggagtaaattctttgacactacttccatttagattttcttatgtctttgtttcctaatccatcaacacaagtccagatccctttctttacaatgccttatctgttttcatgatgcatgcctacactatgtcagcctgctagtttctagcaagatgactctaatcaaacatttgtcttgcacagaatgacttgtttatgcacacccaaattcccatttggttccattacatgtacatcagcagggccatagaggaccaaacccagcttcttttcaacattcctcaagtttagcagacatatccatggtgacccacaggttccgatatgccgtgctggcgaaatgcatgcaacgtacgacacgtaatttcttacaaaatgttgatgttctcagtttctcaccattattaagaatcataatcatggtggtccaaagcttggatccaacaggataatatagcatcataataactaataagagagcccaatcatatgaaattagcataagacttggctttgcttcccgttaattacttcatcttcgtcacaccataatgaagaaaataaaagaagatatgaaagtaacacacatgtcagagtttaataattgctaaagaaaagatggcggtcttcgtcgctagcaatgacatggtggtaactatgcattggatgataagagtatactggagcctaagatgtgctagtccaattgcatctaatgcaatatttagcgagagagagaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagggaggggggggggggggtggagataaactatacattacatttactcctaaacatgaatcatctctatcattttaagaagctctctcaatctgaaaacccattaatctctctcccagtttgactatttgagtattattttttcccattatcaaagaaaaaacaagcagttctgttatgcggaagaatcaacaggagagcatgataatcatatctctattctctgtatatgctaatgtataatctgaacatgacaggttatgaatgtgaaatatattcctaccgagccctttggaggaattccgtttaaggtgtattcttccttccctagttgatatattctttcttccattcaagatgtagaatatattggattctctagttcatataacactttttttcggtctgtatcaagagaagagaatttctaactaaaattttaactaaggatttctaagtaaaattttaagtactaacaaattagaacaaccaatggaagtgatggaataactaatacaaaaattagatatgtatgttgtatagggtgcatttactatctcataaattcattatatcaggagatttgatattggtatcacactctgtagcaaagtttttaataaagaaaaagcttcataatttctcagcatttgatcatttaggaagagtcttggagaacctaggaaattttggagagattgtctttgtgtatttctaagaactaaaaaaaaactagtgcctccattcatggaatatatgaattggaggggttacagtaatgaccattaccaaccttggcattaacaatattttgagaaaaaggaactggtgctgaaaatataagaaaaacaaactagctcttactaatgaaatttgagtaaagaaagagaagaaaaataggaactgacaaacttgaaatgaaactgaagcctaaccttcagtagaatttgaaagagcatcaccacaacatgaagataaagtggagaatgaacagccattggaggactgtcctcctttctttaagtacagagtccatggaaaagaaaaacgcattgcctaaaccacttatgaaagtggtaagagtatccatatctcagacctactaaactctctagcccagatcaacaagccaatcagagcaaagaaactaagaaaatgcaccaaagctaacacaaacaaagatgaatgtcatacgcctaccatctaatctcacctctctaatccgcaataacaaatataaactcctttttgacccacagagagtaaagagagagttgggactggaatgaaatctttggtcactcaagctgggggcagctctttctttgccaagttgtgcttgttgttgtgcatccaaactctgagaacttttctattcaccccaatctcttggcagaactgctccaccacactctcctcctgcctctggagcctccacccaatcctctcagcaaagctcagcatcttctccttctgttctggagcaaatttggtcctgaccctcttcttccccatggggggtgctcttgcccctcccactccatccatctcatctgactctgaggccatgagagcacccaaaggcatgaccatttggtgtggcaatggacttgggatgagacagtggtttgctgggtggttgtagccaaaggcctcaggccctgagatgaggacgcccttgtagcccacaaattttgtttccttgaggtgatggtggtggcactcaccttcaatctcttttctgtggaagttcctgtggcagctgcaggctgagcacttgagggcctccagggtgccctcttcaccactgggcatgaactcaccacacccatcagtggcattaccaccaatggacgctgcatggttcttgaggcattccctatacatcaccactgcccctcctttcttagtgctgtgggttgtgggctgctgagcctctgtggggtttgtggagagaggaggaagaggaggaggaccatatgatgatgagtagaaggagggagtgtcctttgagaggttttggccatgagcaccagcatatttgctagttattggacttgggacccctccatgaccataaagatccattctctccatctccgtgctaatttctttttctttttctttttcttttttctttttttgtttttttttaacttcttgagatgtggagaccagaacaaactgaaagcagatatggaattttttgggtctgaaatccttgggattgtaaatcaagggaagaaaaaagaaaatgaacccacttgctaatttttatttcaatagaaaggcagtagaaaattggaatttgggacagtggagatcctgaagaaccttgtgtggattctcaattcaattttttaagtaaagtcaaagagttgtagatgaactaaagtagattcttgaatttgatctcagatacctgggactaccaggttagagagacatgagaatatgagagcaattctacaaacacacacacacacacacagagagagagagagagaacactgcaagtatttagcagcaggaagctgtgcagataacagttcagttttgagctataactgaaaccagccaattctctgggtcagaaaacctctctcaaggaaagaacaagaaaagaagcaagcagaaatagtaattagaaggtgctgtggaatatattagattaagaagcatgaaggttcccatggacttttttattcatattatagaccaacttttgacatgtactctgaggaatgataacaagatacttaatcaaaagaagagacaattgaacagtttcctgtggggaggtgggagacaggtcctaaacttttccagtcaagagaagaattacaataacaacataaagaactgtctcaaaggttctcttctagacttgaattacccatttcattctccaaatgacagcatggtgaatctaggcaaaaaaaaaaaaaagaacagaacccttctcaagagtaactgagagagaagactagaagagatttatgagaaaaactgcatggtaagcctgaagtaagagctcttctttctttcacaagcaaagagaggatgaagaaaattgcatggggctttcctatgggtatttccaatatgacttacaggtgataacccactgctgctactctagagaaggctgcactatatcttccaactttggattccatgaaaagaagactttagaagagttgacagggaaagaggggaataaacaaagaatatattaagaggtggaatgaaattaggatacatatataatggaggtggttttggtaccaagacactaaataaggggctcctagctgcagtaaataacagagctatagaggttgggaaatacagagaagattttctttcttaaaagagtggatgtttgctttgcttgcactaccaggcaccaagcctacgccagacagtaggagagagaacagtagtgtctgagaggaagagaacacacgcgcaaagagggtccccacaatatagttttgaagtaaaagtgatacaactaccataatgccttcacctatacaataaatgaaaccagacttgtatcattttggtgtagaccaaattacgcacatcaaaattactataatagctccagactattacagcaaacaaatcacactatagagtaattctctaattcaacaaaactacaggtaattgtatttggtattacaatggatatttaatcttgtttgcgacagattcagttacatagatactcaaacttgttaaatttataacttgaaaaagaaaagccacaatgaaataagagatgacttgccatcattttcccccaaaagaaaaaaaaaaaaaggagattatggtagaagttgttatggatcatcgtaatgcttataattttatgaataaaaagccttagaaaagatggaatttgaaattatatatgaacttctcttcaaaattatggtatgaacaatgtaatacttattgttagccattataccaatatataacaaataacataattgagttaaagatatagatgctgcaataacaataaatttaaatataataacatactgttgaaaatgctcgtgtcttttaaacccccaataagaattctacaaacttctattttggggttaattgaggcaatcatattttacagagtaacataacttcaattttcacttcttttgtctttaattaattgttcgatagaaaaaaaaaatttaaataaaaggatgtgtatgccaattaaatttgaaataagggggttaatttcaagattcaaagatatgtgggtcgcaaccttaaatcatcatattctcttttttttaatcactaataattagggtttggattattcattgatctaactattccatcattcaagaacctgctgggtagttgaataaggttaattattatgatatgaaaagaatcatttactattaaggttaattattcttctgacaaaatagtagttaaatagttggatcataaatatttgattgcacgataataatggtgatgcacatactacgacgattcctatgccaatctacaaatattttttctaagcttttatgctaaaatcaccaatcaagtcgtgcaagacgatcttggcttgtggagtaggctgaattctcttgttattagttactattgtgctgactcatccatgtgatcctgtattgaccttctattgggtttaattgctttgtcttctctcagaatctgcatgacaaggatactaccaatgtgcagacatggaatgttaggaaagaagcttggagacaaggtctgaaaatggaggaagagtctgtatcacggtactgtgaagaaattattaaacagtcttgggggtgtttggttcttaactaaaatcggaatgaaaatgaaaatcagaatggtttggaatcaaaatcggaatgactaaatcttccgaagtgtttagttcgtgaccggaatcgaaattggaatcgaaatcagaattcgaatgaaaatttgaatctatagagaatagtaggaattgagttctatatagattgagccattcccattctatcctggaatcggaattggaatgggactctttccaaccaaacggttcgaatggaagtcatccattccgattttgattccagacttccactccacccaaacaaacactcctatagaagacataataaacaactctggttgtttttgaaccttatcctctctgtagtctttgtttatgaagccccgaactttgtatacttttgtaacttcaatttcctataatttttgaagtttccctgactgtgtcgagaaagatttgctttactctgtaaatatctccctataattactttcttttaataaatctgggtggcaatccttgcttcccttttccttaaaaataaaaaagttgtgtaagaccataattcagcatatgtttcattattttttatagtccaagaagtcagattgaattatatattccattaatttgaagtaaagaatcggtagacgagggcaaccaacaaaagttaccaacacccaaattcaaacaaagcatgccatgcaagctggttcaagacttgcaaaaggccttgtcatgctatgattcagctcactctacactcatcaaactctggttattactttttctttctttcttcatggtaatgaaacaggaaggttccattatcttgcaatacaatcctctaccatcttgcaacttatggcatggatatcgccatgtctcctcattatgcccattagaccatgagctgccatgatatcattttaacccaatttgagaccatactttccaagtagtgggtcttctttcatggttccaactatggcatgcaatgagtgtgatggccaaggatctttcaacatagtaaaaaggcaactaagatatatcagaaagattttgtgtactcaaaacacaggctagaactccgaaccaagcaatgtttgtcctttcaaggaataatttgctcatagtttggaatatagatggctgtaatgtagatgatccgaaaagctagttttatgaaggcctcacaaaatgttggatattccaaaaatatgataaacttgatgacaatcaagctcaacacaactggattctaggagcatgccaattttgagctgaaaaaaatcaaactctcttcatattctggtgataagcagggctaatgttctatcacataatagctgtataacagtgttttaatgagaaataacggaacattatcgaaaataatggtattatcttttgactgcatatcttttttggatgaaaattgaagaaaaaaattctgaaatttgcaataaatattatttattataaagtacaagtagaaaaatgcccatcatgttgccattggcacaacagccaatatttataccatcattatttaaaactacgctctatctataccttgaatttctcccttttatttaattaatctcggtcttatcttgtgtattgttccccaatgtatttcatgcacacctttgtccaaaaaatgagttaaagactttttaaaattaaggttgaaatactgttcaatttttttatgctacttattaattattacgatgactatagggtaagtagctcatgaatcctatatttcttttcaatgaactcaatagtcaattgatactttatataactagtcgatgcaaacatagtcgccggtggttgcacaatacttccattaggaggagattacatgattgaaccatgaaagatgcttcctaaatgttagatatatttgatttattattattttaaataggaaattagtgatgctttcattatcagtttttgaaaaatagctttgtgagtattcacgttaaattggtggctagaaaatgaaaagatgatgtttagtgatattcaccaagttgcctttcagttccaagaatatgaagcaaaataagcatcagaatgctatttccttgaaacaatattccaacaattcaatctactaatgataaaaaaatcatgactcttatcatatgcagtgcatttcattttatgcaaaatatatttcaaatatttaataatgcactagttgggacaatcaaatttgctcctcctgattctatgtcagctcccatattcgagatcggccttttgttccatatctatataagaagagccaagagatcccaagaagagaagctgtagaagggaagaaacttccaaaattcagctgtcatgagaatcatctagccgaagcagagtcattatggccaaactagagtcatctgaccaaaacagagtcatcatgattgaatttgagtcatcaagactgaagccacatcttcatagccgactgactattttcatatcatggtcaactgaccatcttcatatccgactgaccatcttcatagcatagccaactgaccatctttatggccgactgacaatcttcatgaccaaactagtatcataatggccgactgtcaaatgattgactgccaaatatataatcacgatactacaatcatggataataattacatgccacgatcgttagtaagcataaattatccactaactccatgattatggtccgataattggggtaactaccccttagtaccataaaaagcgggaccatgtgctcgacggttacacccgaatcacctataatgggaagataaaggaacagacaagagataagacacttatggattgatactctgtcaattttgatattctactttctctttaccattttccactaacttaaatatcggagggtctccgtcggatacaactgcagtcagtgtagactttttttgcaagtgctcttcaccgacgtcaggcgctccaggggattgatcgcaataacaccatttaaaacccaaatccaaaataatcttcttttagagtatagaaatgctatcattaatctaattgatatattttttaacattattaaatatgatactttacttgttccatcatatatgacaagtattatacccaaaagacttcatgttttgacctcaactacttgagcaaagattgaacgacagctaactaaacactttttgcaggacaagaccttggctgaactatgaatagagacgtggacacccacgaatttaagaatctcaccttcattttggatacagacgttaggaattggccagggagaagagatgaagtcaaaatcctccacaagagtgtctcagtgtcgtagcactctaggtcttctgtctactccctcataataaaaaggctgggcatcgatcaatgccttgaccaaagaaagagacacagtttcttaacccatgaatggaggcatgcgagcttaccttgggcggagtgcccacggatgtgggtttacgatggcttgaaaagaaagagaaaaagaatccaaattccatgacatgcgatggcctgcgagagagtttttatctcccagcctgtgaagagtagcgggttacaccgacgtatcgcaagaagttcaagtttatcgtacgactctaatgtttcccatctcaccgatgcaattaggctgagggtgaccgagatccgtaaccttaaaatatatatatattttttttaaagaatgaaacttaccgagtttaaattaagggtttttttattttttaatatttttcttaaatagaaatgtgaaatccaatctcaccctcaccccacccaaccacacccggctcttgctcttgccagccatctttccatccgatgccgagctattacttgttcttaatcagagtcggttccaatatccccattaccttttcctctacttctccttcgattgcctttttgcctgatgttaatctttctcccatcctcgatcatgccactgactctattcccctatgtcactggtacttattttaaaaagaagaaaaagaaatgagttaaatatattttttgttatcaaaaatctaaaaaataaaatttatatttctagattttttttaaaaaaaattaataatgatgccaaatataatcaaaatcatcttgaactctcttatatatacgacaaactcttgagatttagatacatctccttgtatgttattagtgttgattagaaatatctattttagccgatccattggatatctgatctgaatggaatagattttatctgatccgattcgagcctagattgaatatggattttagaaaaaatatctgaagtagattcgaatcggatatggataatggtatgtcctaccgatctactccgaagccaattagatataatcttaatatatatttttctttcaaaattataattattttataatatttatatgtatccaatccaatctaatccaatcccacccttcttatctattcgacctgattcgactcgagatgaatatgagatgagcatgaaatttttaattacggaatagatatggatattaactgatccaatctatcagtcaatatctatatccgatctgttatcatccttagtattgacacgtggataagctagcatactgaatctatattttatcttatattaagaaaagggatgggtttgggataggttaaggattaaatttgcatcatgcagttttgggttcagcaattattttccttgagatgtgcttccccaacttctgaaaatatgacatttatgatcaattaattgacttgttagctggtagacaaatctgtttttattggggacgtaaattttctctgatgcacttttaatactttccattatcggaggttgctccaccccttttaggacgtacttgcttgtgtgcagggctggaggcagcgaaggggaccatggttacaaatgttttgctcctgtgagcccgtgtcattccagagcaatcgcttgtcaagatatgggattttgtcagaggatggtgggcctctccatctaatcaaagaatctgcggtatatttttttctccatcggacgtagtggacggagaattccgcctagccaaagacatcactttacaattaccttgaatcgttgcaggagggtttgtcatttattctattcaccatacaaggatataacaacaatagtttgataataatcacatgaaatgcacaaacttttgtaccgtattatattaaaatcttccacacttgctcccgtcacctgggacaaaaagttttatttgcatataaacccatgactccccttaacttcacgcaccggtgcccgcaaccatatgtcagttgcatttatgtcccccgattttattttacacctctccatccctcagaacttgaagctttgcatcaattgatcatgtgaagtcaaaagttttagattcttgaagcacacgcaatttcctatctggattgttagtgtgtcaacagtgacaacatgtacaatttctttgagccctctggaggaggaataaaggacaaataaaagggatgggagaataagagggtgctacttggtgaaaaagcttaaatccatatttttctttgtacttagaatattggtcaagcgaagcaactaatattttgagagttagtgtacaaatataagaaaatcagtatgtaaatatttttaaaaaaaatcaagaaagtaatatgcaaataaagattttcgagatcaatatagaaaaatctaaaaattagtaccaaaaagcatatcgctgcagaagaccgggacaacggtttttctgggtgagcatcgagtgccttgtggttagtgatcattattccgaggatttaaatcaataaagtaccacccatcagacgtcgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttgaagcatctagccagagattgtcctcaactcagggatcggatgagggcactgcagtgatggccagtagcaactcaaagggtgatgctttggagatatctggtgaggtatcaacttctttctagcagtggattttagattctgcatgcatctatcatgtatgttgcagagaggagcagtttgactccctggagagcagtgagagcactgtttatttgccggatggatcgagttgtgcaatcaaatgcattgggatgatcagctagagaatacatgatggtgcagtgagaaacttgggggaggtccgatacatatccgattttagatgaaatcttatctcactgagtagactggattcgagaggctacaggacggtagccggtggaggaatcttgaaggtgctatgcgacgttaggattgttctggagggaaaaaagagaatgagaggacattactatctagtggggagtccagtacgaggtggagcttccagagccaagaggagcccagagcgagatggagctccaggtggaggtagatcgggcactagacgggagactcggaaagatgagaggcgatgtcgtatggtgagatttctattaccgtaggagacttctccgagcaagtctttggttagagtggacatagctcatgatggaggtgagatcgagcggtctggctcgactcctacatttgtccatccatgagacagcaggcatgccccaaggcatgggggtaaaatggatcacaagctctcagagatatgtggaggtcgaatattgagtcgaggtaaagattgttatgaaatacgtctcaagattcagttcacattgagcccacagcgagatccaggataacgaacgaagtctaaggagcctaagaacagcccaaacgaagtctaaacggtgaagatatgcatgaaagaaggatggcacggtgcattaggcggaggccggtggtggcatcgcgaggcccggtggagacgagcgcacgcaggtgcgcgcggcccagtgcgtgagcgggcccagtgcaggcgtgcacatgggtcggcccagtgcgcacgggcgacccagcacccctgtacgatccaccgtggaccacagggcgctgggctagccatgggaccggcgtggatcgaacacgcggtccacgcgtggttcagggtagtttttgcatgatctgacggccaagatcacaaccgaactcgatcgaacgactgaggttgattccaagtttgatcaggtgatcagtggccttgatgtgcacgatcggacagctctggtgcgagccgatcacgattgaacggccatgaatgattctaggcttgattgggattttgttttttagtgtaacagtgttttagagtttctggagtctatataactctgattgataagtcgtcagttgtgttgggaagctggtgacgtcctgtaggtgtagaaatacttcaacagagattttagatagcttttgtgagggtttttaagattttttttgaaagactctggtataaaggttgagtggtgagtttctcttgtattgattttattttattctctcatagtaaagcttacacgttccatgaagataggctcgaggacaatccacgtatttatattatattttttattttttttttctactgtatcatatggtatcggatcctggtgtaacattttttctcgccaatcgccttcttgaccaaacagttcccgcagaggactattgtaacggctgccatgtgggtttcggcacctttatattatattataaataaaataatagggtgtatagataataattattataatattttgtttagtattataatgatctgttatgacataaataacaatttttatcctacaccttcctctaggtaaaatatttttaataacttttttgcattaaattttgctccaaaaacgtttgtaaggtggcacaaatattatataatttttatccaatgaaaagtatatggaagatttccttaaatggtgggagcaattatggtacaactccctcccaattgaaagattatagggagacttttgcatggtagaaggtttcactataaaatagacactaaagcatcacataattgaggaaaaaactagaagacatgatactaatgcaatgcactaaattctaaaatgaatagcattaatgaaaatgggttcaagaactagaactctaaataccattagagtctcaaaataaaaaaaaaatagattctatttttttaaaaaaaaactatcccactaaaaaataaatcatattatcattacggaaagagcaacagtccattcataagtgcagataccataagaattaaaaaaataataaaaatattactgataataatataaatataatagaagaaatagtcaaaaattatgtagtcataatttctatattgcaaattaagacgatcactcaatcacatatggcaactacaaaccaatttcttgattgatggcttgactttgatacaataatacatgtctgcaatgacaaagaacggttcacaaacacgaagttgctgctgttggacaaggaatatagatgaaaaaacacaatcttatcggagtgcttagcaagggaacaatcgaactccacttctgaacagaagctttattaaatatactgcatgttctagaaatttaaaaaataatttcaaaaattaagaaaaaaaatcctgtatatgctagccttctacataagaacggtttaaggctattctttagtctggtaagttgattttatcgaagaatagaatatttgttgggaaaggttatatgttcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttatataataattttaaatataaaaaataatttaaaatttaattttaatgtattatgatcaagacatagtaaagataaaaaaagctaaagttttgctctagttaaagcggatccagtctgtccattatcgggtgatgaacgtgatgtcattactagcggacgggagttgtgatctctggacgtccaaccaattaaattaacggttcgatgattccccatcttactgcagcgtcctcccgagttaaaaccttcgagcacctcaaacagctccatgctcagcttatcctccactccctccatggcgacaaccactggctcaccctcctcctcacccgctgcgcccttatccacgcccctctcccctatgcccgcctcctgtttgagtctatgccacacccgaccgcccgctcattcgccgctatgttcaaactctactcccaactggggacataccgagacatggccgccctcttcgctcgtctgtctagtcttgccgtgaggcctgacgcttccgtttattccattttaattaaattgttgggtcgcgatgcgatttcactccacgcccatagtttgaagctgggacatgcatccgatcgctacgtccggaatgcgatcatgaatctctatgcccaacatggtcctattgagactgccgaaaggttgtttgatgaaatgcccgagagaatggtcgttgattggaattccatgctgtcggcatattggaagtgggatcgcaaaaaggaggcgttgcgaatgtttgattccatgccagaccgcaatgtaatttcttggaccgtgatggtcagtgggctctcaagggctggggaattcgaggtggcacggaggttctttgatgaaatgcctgagaggagcattgtctcatggaatgcgatgctttcgggttacgcacagaatgggcaggcagaggaagcattgagattgttcgatcgaatgatgggtgtgggaattcagcccaacgagacgacgtgggtcacggtcatcacagcgtgctcgatgaagggtgaccttagatgtgccgaatccttggtcggctctctcacagagagaaatgtgaatatgaattgtttcattaagacggcactcatagatatgtatgcaaactgccagagtctggcaaaggcaaggaagatttttgaagagatggaggatcggaatttggtgtcttggaatgctatgattgctgcatacacaagggaaggtgatctctcagcagcaaaggagctctttgacataatgcctgcaagggatgtagtctcatggaactccatgatctctgggtatgcacagaatggacagtggattctggcgatcgagctctttaaagagatggcgattgcgaagggcttgaaaccggatgaagtcacaatgtctagcatcattgcagcttgcgggcatttgggggctcttgagtttggaagatggctagtttgttatatcaacgaaaaccagattagattaaacatctcagggtataatgctcttatcttcatgcactcgaggtgtggaagcatagaggatgctcggagagtttttcgagaaatgtccaagagggatgtattttcttacaattcattgatttcaggcttggcatccattggcaaatgtctcgaggttcttaaattgctgaagaatatgggggaagaaggcatcaaaccggatgatataacgtatcttggtgtcttaattggttgtagccatgcagggctactagttgaaggctgcagggtgttcgagatgatcgaaagcccaactgtggatcactatgcttgtaaggtggatctattaggtcgagctggccgattagatgaagcaaagagagtgatagatggcatgccagtaaagccacatgcaggagtctatggtgctcttctcaatgcatgccgaatccataaaagggttgaactggcagagtttgcagctcaagagctcttcaagctcgaaccagagaattcaggcaattatgtattgctctctaatatctatgcatcagcagggagatggggagatgtggagagtgttaggggaattatgcgaaaaagaggtgttgataaaatgatagggtgtagctgggtagaatttggtggtaaagtgcaccagtttgtagctggtgataggtcacattgtcggtcggaggagatgcacaagatgttgaaagaggtaggaaggaagatgagggcatctgggtacatagctgataagagttgtgccctgagggatgttgaagaggaggagaaggaagaaattgtggggacccacagtgagaagctggcacttggttttgcactgcttgtttttgatgctaaggcagtgatcaggatagtgaagaacctaaggatatgtgaggactgtcatgttgccatcaagatgatttcaaagattgaggagagggagattgtggttagagacaacaacaggtttcatgtctttgaggatgggaggtgctcttgcgaggactactggtaaagcctcagcgcgggcttttctcccgctcagcagtcggtggagaatcgccgccgccgccgccggacatgcaagcagctcataaggctctcatcgacaaagtctgagcggccctccgacaatccttggtgatgggcggaggtggggttcgtgccagccccacggacgctcgccatctctggacttgctcgaatgcatctgaacggtgcacggcatccttatatttggggcagccctcagtcgcctcttcttaaattccccttgttttggctgctccattccattaatgttcccaccatgcatggtgaagccctgcatgagtgcactgcatgcagtgagccattacagagatgggcgcgtaatgaatggaacccatactactgcttttgctgattggtggcatataccagcacgatcttgcatgcagtatccgggataatttctcgttctcaacccatgtccaatttttgctttgtattgagtctacaaaaatcttaaagtagattgtatcattgtgcatacacactatgttgattaaaaaaaaaaaaacgaggaacatggatcctctgtagtgcatacgcagtataaaaaaatggacaaccatcaaagaaggcagtccatgagcaaataccatgttatacgcgacatatgttgtttgatggccacctatctcttgttggtacaacagagttttctgcagtgcatggacaacaccgctgggaatcctctttgaagtatgcgacatgcctcacttctacaaataaataaataaagaaataaataaataacaaaaataaaaaaaaggacaaaaaaacaagaaataacagttgtcaatacgtgttgattaggcaatcccatccatccaaggtttcacgaagctcctgaaaatgaatatcgcgtattacaaacttccaccctgtaaatagaacataatgatacttctgtgagaggcaaaaacatcaagtgtgcaaaaactcttgtccagatgcgacaaccatcgtctagagaccagaaaggctgtccaaactttgcccagacctctttaccaaaagaaaaaaaaaaaaaactttgcccagacctaataaaaagatgccggttgctagggcccaatctatacatatatacacacacaaacacagagagagagagagagagagagagagccgttgtccagaagaaattatgcacatatttccaaccttcggatttgacaagacagcataattctttgcacaaccaaaatcaccaggattgttgaattgctttcctcaaaatacggggaaaacaaaaattgaaccgcaaaccgctgcttcttcacaacagatcaaatacgcaggtatttggcaaaacattaaccacaatggcgttggtactcggatcagctgcagagtagagaactgaaatcaaatagctcgatgcaggtgcgcctgagaccgggaagtaatgcgccaaattatggctgagaacgatttatccagcagaaataagcagaagaaaaagagattaattaatacatcaagtgcaatcaaatgcgcgaaaagaaaacaaaaaagacttcaattgcaaaggttcactccacaactcacacctaactctgtttcttccaacaatgtagtttagaacattagatatcactcatgacacccgaattcttacccaaagagacgacagtaactaacagtaacataccgaacgagaaattaattaaattacgcctgaaacctagaaaagcctgacttgggcatgcaggtccaatgattgttgcatcccgaaatggttttcctattctaatgcatctgcaatgatacttgtctatgctttcatgctctagcccttttgttgctgcatcctgggcatttgtactgcttgatgtgctcagccctagcaggtgtgatcctgacgcacttaccatggaaccatcgctcgcacacatcacagcatatccagaattcatcatttgcataattgtccccacatgcaccgcacaacgtgttcccatgctcctcatcatcctcttcctcatcctcttctccactctcgtcgtcttctttcgggggaggtatctttaaggtctttgactctgcctgccgtgactgctgggaagcgaagatgaggcggtaggggcagcaaaaattagactcaaggtgtcagacgagaaagaagaaaacaagacattcaatataaggaactcatatataccatctttgagcttgatttgttgctcttgctactgctgttaggggttttgtctttcgattgcttcttagcagttccagtcacaacctcatatatggtggggagattattgatcatgttgaaaagccgcctcctgtaaagttatgtgataagataaaccatgccaggcattaacaattttcatctagtaagtcagaaaagaccaaatttcaataaagagatgtggttcctcagagaaagctgcaaactggaatatcatatacatgagtaatgacagaagatatcttcagcagtctaccaattaaacagggaaagtaaatacaaagtaataactgtaaatacaaccacaacatagggcaaatatttgtgcaaaggtaaaaatcttcaggtttgaaagctgcagttcaccacaagaacatagatcataaggtgcaagcagctttcaagtttgatcaacattcagctatatattagcagtttcatccataaataggcgttgtctaaaataagcagtctagacgaccaccacccaccccaaaacaacaaaaacaaaaaacaaaaaaaggaaaaacagaaagcagcaaaaaaaagaaatggggaaaaggctatgcaaagaatctattacctgtacaagcaggtcagacatcattataaaggaaaaatacaaaatcaaaaaaagcttgcatatagaaaatgaacttagtctctgatccatgatcgagaattaaaccatcatgatatgaagtaaacaaggagataaattaagctacccaaataacatgagaattaaagacacaagaattaatgatgcctgaatatctaattattgaacttgactcatttgtacggaactatgatcctcttcagtgtatatccataaaataagtctaagtaatacctttgtctgcaagtcactttcaaactaggtcattgcacaccagccgttccaagaaccattttgtaggcacacaaggagatcaaattagtatagattttgccccaggtatagaacaatttgtattattatagtaagaaatataaaatttgacaccatcacaaatattaaccgtgcaatgtgttctctttcttcgcagtactatcaagtcatatttgcaatttataatagtgaatcttcatgacctaaccaagtcacctacgaactacaacagcctctccagaagcccaacaacactatcttactcgagaaaacattgatattggttcatgcatatgattatttaagacaagaaaggaataatcctgggaaatcattgagcatctttatgcagctaggtccacattatgtttaactctttatcggcatcgagacattcaaaatgcttcaaataattagtctctgggtgcaaattttgcctctagtgctttctgcaaaagctacttatccacgtgtatcatgtgctttcagattttaatagttttctaacagtcaaatatgtttgtatacagagaagtttgtttcaagtatatttccacctaatcaactgtgttttgataactacgtaactgcacccctattccctaattctctatggacgatgctccaagttcaaaactagttagtgctcctcaagtatttggacctaggtaatttgatcagctggatctttcctccctttttctcaaacaagaattactctacaagtgtttgctgctaaatccttacataatttcaaatcctatactggcatcagtgaaaggttaaggtgtcttttcattgtaattgaacagaaaacagtgacatgcatggcaaccaagtacagtaatcataaccataacaaaacacatcatcataattgcgtgtcttttttctaaaaccaatcccactaaaggaaaccacctttgtcaacaacaattgctttaaagaacttttctcgcaaatgtcatcaagatttttgtaggtcctcccatcatatttccacatccttttaccaaattccaatcccagttccttacccatcagatctttaacacacatgacactaccagctctttttccttacttgcattactttaaggcttcgccactatctaaaagaaagttcccctcaatctcaaaggtataaagtaagtacagaacaccccagaactatcaaccgccaccctttcatccacctaaatatgtgaaagatattttcttctaaatctccattgtttcatataacaaatgtagatagcaaaatataatattcatgtatttttgggccataacatcagccttcctttgactttattgccgctaaattacattccacatgttaaattctggttcacatgattaaattgaccatcattctccagagttttcctccaccattttaaatttcacactcacccctattaaatttttaattgtctcaacacatttgcagataatatacaaattggcacatctcttcaattaaccgcaaccagttgatcaactatggattcaccatgcttaaaaaactccctcacctcatcacaccaaattctagttcttggaaggcattccttcctatgcccttaaagatatcaacataaatctagattggtttctttctttagcaccaacaaaccagcttattctaccattctctcttttctgaaaaaaatcaagtaacaacaaggagtacattcatccttttcataactctttctatcaatgaccaagaataaatatagcaaccccccaatttaccttcttagtgcaaagtcaaattagatcaaatcattctactcaacatggtgttatcattcttactagttccttcccaatgtgtatcttaaatctacgtccacagaaattaatgcaattcatctctatttattttgacatcaccatgatcactcatcttccattatatgggatttgtcgtatcttcattaacctgtataagattgtcaatcgaataaatccacatcctcagatacctttatataccacatttggtattctaaacagtcccatactcagctctcttactttttttcttttccaaccttgttacaagcaattatataaattataatttatgctatgataatcatgtatacttccacctcatctacaaggcttccatcaacaaatatggaaataacttcttgatcaccatttgcacgctcaaaagcacagagttgcaaggagatgagagaccaggcacaattgaaaaaaagttgaagtggtatcataaatataagtcataacagctgtaatatcaagatacaaagagatatacattgactaaaatgacatgaatttactaattacaaattaagctcccctccatgatcaaatgaaatggtgtatcagacatgcatctcatcactagtagcatcaggggaagagggttgatgactgtgcgggttgcatagaatttatgatacacaagttttctatacaaaaggaaaagagggaagtgggggcgttggggtgtcgtaccgcccaagaaaaaagaaatctaaacaagatttctttttggataacatattttaaatgggctgttttgttacatggctatttactttaccactataaaggtctacataatgttcattattgatgcccaatgactctactgttagatgtatgtcctaaaagccagattggttgaaacatgcacacactctagcgacataattttataattataaatttgaaataaataaaatctggattattttttcattcatgttgtgtttaaattgtgtccatgaatcgtccgaggaattaacggatgataacacgtattctcaaaaattgagaatttgaggcacgtgtcattagtggttaatttctaaatgctctcgttcgatagaacgtcatggggacgatgattgatccggacagatcgatgcatggatcacttcccttcgtgaatagatgagtctcgagtcaagtgtggggatacttgagcgaaagtccaggtgcttaatagagattaagagtactgagcgtgaccaacacgagaagtcactagaatggctgcccactcgtcggtgacttgctcaaagttgcagtggtgtagatagttctttaacctgcgatgcctcagctgcttacagcaaggttgctatagtttgactgcataataacttgatcttctagccatttggagccttgagatgtatgttggctacagtagatccattgtaggaataggatgagcatcaaaatgaaatttgtcgaccccgatagatagagagagatccaatgtagttcataaaactgagtcctaaaatccatggtcatggtagatgaatgatgaaaaaaaatttcataagatttcacatggactcgagtcaattgaatctgacatatgacgaacgaacaagtttgacgagttatccttaaccagcatcttatcgggactcacgatagaagaatcgaactgcacctagaggttcattattcagttctaatggattgccactacatactgctaggtgtcactggtggattgtgagactaattaagaatcgttttgataatcaatgattcttaattgattgaattggaaagagttccaatccttcgaaaagagtttccatgatattgttgatagagatcacaatatatcttactatcggatggaattagacctatggggtcacacaaacaagaattttgatctaagattgcacaattgggctaagtgtagtctgattgagttagaattaattaaagtcctagctttgggtttaagaaaaccctgctagcatatggttaaacccattttttcctacttaatttgggttccctatcggataagactcaaccaaattgaagcaagctcatttagaacaccaagagttggagtccttaaagcaagccacccatgtaagaattaaatgatgggagggggtgccaacacatgttttcttcgactagataagaggcacacgccggcatggataagatccatgtgtgtgccgcttacttggagataagggagggagaaagagggataaaacccatcctcttgcagataaggacaagaatgaggaggttacatctgaattcaaatttgaatttgaatatggattcgaatttgaaatatttgaattcgaatctgggaggattgagttgagcgacaactagcctatccttggtgtacgccaatctgaatttttccttggttttgtgcaataaaatgaggtgaaaaatcagggtaggcggcagcctagcaaagtcctgctttaaggcatttgatccgatcaaatgtctataaaagggccccaatcaaatggtttgacaacttttctcattagaagaaaaatcccaaagcccttctctcatatccacgcctcctctccctcttctctttgatctctcatcctctcccacgtccaaaggtgttgggcggcccatctggtggtatcgaggtgtcgagttccatcgatatacgcgaaggaacaagaagacagcgatcaggccttgatcagaaccctatcgaagatctgattgaaggctaatctaggagcttgcagatccatctaagagtagacggatcgaaaacggagagagtatcctaatccgaatccaaacggatacctgtagaggccggacacgtgcacggcttaacagcgaacctcaaatccacgatcatcggtttgcggagttcatctacccgcacaaggtgatgatatgatcatcattaatctcatttaaaattgttttaaatttctgattttcttaatctagatgcatgatcgatcttgctacgatcgagatctgatcttgatcggatcgcatgtcggatcgaaaaatttttgaattccactgtaccctaatcaaatcgatcggacgtgcgatcattccttcaactgatatcagagccaggttgtacagatcatgcatcttaaattaagatcagatctaaatcaaattagatctgagttgtgtttagatttgaattaaaaacgattagatctaatttagtacatgaatctgaaattgcattagatctagatttcagcttttcaaaatgatcagcgtgtttaaattagatctgaattttttgctcttattaggactgatttttatgctgaatctaaaggttatgattaaatctgaaacttaagattagagaattaaaaatcagaaacctaattaagtgcataaatcttaacataagtgttatgttgcatgaggtgtattttgcaaaggatcatgtctagatctattttgcatgagatgtaattagatctgaattacatgtttataatctgatttttatttgatacatgagatgtatgttaaatctatgttgcataagatgtatgattaaatctaaaatcaaatttaataattagattaaatctaatttaaaacatgtaataatgatcctatttatacatgagatgtatgatatctttatcctttatgcatatatgatatgtgtagatgtagtgtcatttctaagtagcttagtactcctcaaagtccatggtaaaagccgtcctgccatagaggactatgatggaagggatgccgcatgaattgaaaggaagaactgcgaaatgaagaaacttaattttctacaaaaccctagatccaaaaaccctaggatctgtttgtatatgttgcatttaagttgtttagaattgaaaattatttccacatctaaactagaacttttaatgatgcacatataatccgaaacattgaaacttgtggctgacacgcctgtcgagtcaactcaatttttgtttgagtcgactcgatactctgatgagtcggctcaattggcaaatgagtcgactcagttgtgcagactgaggcttacaggatttctgttcgtcacaggtgagtcgactaagtctcagagttgagtcgatttactgtgatgagtcgactcaaatccagagtgagtcaactcaattctgaggacaaaaatttggtatgagatacaatgtaatgtagtttagaactaaaattatttcgacatctaaactatatccatgttcataatgcacttaattaagaattaagacatgaatctaagagatctaaaattgagaatttaagatctgaagtctgcataaaacatggggttttgggtatgtatagctcaataagatctagttttgagcgattgatcaaaccgaatcaaaaattgattaggattaagtcaagcgtgctcatgactaatccaatagttgtagattggttagatcgattaatagccatatatcatcgatcaactcaaagacctaatttggctcaatggttcaagcccgagtctaggctgacctattcgattctaattgatcaattgatgtctaaggcaagtctcgattgtgatttttaattgagatcatgcttacctggccatgcataaattgtgtctaagacaagcatctatatccctcccaatgatcacacttatctgaccaacttgatcgattaagttttgaattaggttgcttgatgattcgagctagtccatgccactagattaatcataactgttatgattaattaaggatgagacctaaatcaaaatctcctcaataatattaagtcgaggggtcttccaccattatagagtgccgtgccctcttccatgttgactgttctggactggatacagtgattcagttgcatcagaggagaagcaactactttatttgtagtaggatgaagatagggttggacctaagatctgtcagatgaagatccaatgacggtttcactcgcgctcaatggtgggtctgacttaaccaaaaaatgaaatcaaaatctatcagatgagatctcagaacttagagaccaaatctgctgctgcaatttacttgagaagcattgggcaagagttgaccacccattggttgacatattcaccaagacctgtcaggtgaggtggtgtgccaattggtgggaccgcagtacccactaggaaccctaacttgcgaaggagtttccgcttcctaacccgaggagtgttagaatccaaagaaatagtgggagctccgcagaaataatgagaactaagtttgtttctaaaataaattctctagaataaactaaaattaattacaaaagtctaactaaaaatttcctctctgtagaattttgtctccttctaatagtctagcctgcatcttaaaaatcaaccaattgtcaagttccaactataaggattggctaagggacttgaaaagcattttgagttccaagaagctagattatgtcttaaaccaaaaatgtttattgggaccatgaagtgttcaaaagacacctttagaaggtatgtcggacttgctcgtgattgagactaacctagcgatttcttctactaccagtatacacttgtgcacttcaatgcaaggtcttaagaaatgtagaaggttgaaacaaggagagatgaccctatgagtaagcaacagagcaaagattactgttgttgtcgtagggacctatcttcttcgattaccgtctgatttctatctagaactgagagattgttactgtgtacctaatacaagcaaaaatttgatttttatttcatacttagcacagaatgattatgaaattagtttcaataaggaccattgtactatttattttgaaaataaaatgattgcacatggtcacttaatcaacagtttctatcatttgcatgttgctgcagatgaatcaattaatttatccgagcaaacagtgagtgacgttggatctaaaatattcagagatgaagttaacctaaagtacatgtggcaccttaggctaactcatatcggagaagaaaaaattgacagatcggtgaaaaatgatcttttagactcgttctcggatgagtcgatttcggtctgagtcctgccttcagagaaagatgaccagactaccctttgtaggacacgaaaaaaagaccactgaagtactaggtctggtacatagtgatacatgcggcctatttgatgtgccggccagaggaggttctctacttcacctttaccgatgatttttcacggtacggatatgtgtttcttatgagacacaaatctgaagcctttgaaaggttcaagaaattcagatttaaggtagagaagcaaactgagaaatcacttaaggtacttcgatcagatcgagggaaatacctaagtgaaaaatttctcagttatctcaaaaaaaatgatagtctctcaatggactccacctggaacgcctcagctcaacgggatttcaaaacagagaaatcagaccctattaaatatagttcgatccatgatgagcttcaccgacttccctttatttctttggggacacactctaatgacaatcaattatttaattaataagattctctctaaatccattcctaccacaccatatgagatgtcgcatggtaagaagccgaattttggttatctcaaaatttgaaaatatccgaccaatgtcaaacgacaacgacggataaattagagactaggtctatgagagctcgttttgtaggatacctgaaaaaatctttaggatactatttttacctcccgaaggatcataatgtgattgtgaaccagcatgccaaattcttaaaaaaagattttatcaagatggagatagtgggaggaaaatttagctcgaaaagaatgtctctgaagaacggcgagtcataaaacctaaggaacccattccatctcgtagatccagtaggatcacacgtcctcctgaaagatacatggatatactggaaaaggatgtagagaaaatgttcctcataggtgatatgaaccatgctgatgatcctaaatctatgacgagacgatgtcagacattgactccaaaaaatggttggaagagatgaagtcagagattgactcaacacatagcaaccagatctggaccttagtagatccaccagaaggaatagttcctattgggtgtaaatagatctttaagagaaattggatcggatggaaaggtggaaacctttaaaactaagcttgtgactaaagataatagtcaacgcgaaggtgttgactatcaagatatctttttgtcaatagccatgctgaagttcattaatacactgcttgctattacagtaactcatgattatgagatttggcaaatgaatgtgaaaactacctttctgaatggatatcttgaggaagatatatatatggagcagcttttgaattttacatccagtgatggagatcacaagatctgcaagctaaaaagatccatttacggactaaagcaagtatttcggagttggaatactcgattcaatgatgcgatcaaaaagtttgatttcatcaagaacgaggagaaatcgtgcatgttcaacaagatcagtgggagggctgtcacattcctcacattgtacgtggatgacatcctcctaattcagaatgacatcctcatgatgacttctatgaaactttgattgtccaaagagttctccatgaaagaccttggagaaatatcctatattctagacataaagatttatagagatagatctaaaaaaatgcttgatctttcacagcaactgtacatagagaaagtgctgaagcggttcagcatggagaatttcaagagaggtatattatccttcagtcatggagttcatctctccaagaagatgtgccccaacacacctaagaagatttagcttataagcaagatcccttatacttctgctataagaagcctcatgcacgctatgctatgtactcgacctgatattgctcttgctgtaagtatcacaagcagatatcagtcgaatccagatgaggagcattggattgctgtgaagaatatccttaaatacttaagaatgactaaagatctcttcttaatttttaaagatttgcgggtacagagatacacaaactcagactttatgtttgatattaatgatagaaagtctacatcatgttttgtatttctgtgtaacgatggtgcagttagctggaagagtttcaagcaattgattattgcagattccaccatgaaggcagaatacatcgccgcgttggaggctgctaagaaaaaattctggttcaaaaaatttattgcagagctggatgtgatgccaccagatgccattccactctgctacaacaacaatgatgccataacactcactaagaaactgaggtctcaccagaagtccaagcccatcgagcaacaatttcatctgattcacaaatatctcgagaaaaaattcgtcaagatgcagagtcaactccacagagaatatgactgatccgctgaccaagccgctgagccaacagaagactgaagctcaccttgagaagatgaggcttaagttcatggtcaatagactttagaccaagtgagagtttattagatgtatgtcctaaaagtcagattgactgacatacgtacacactctagagacataattttgtaattgtaattttgaaataaataaaatctggattattttttcattcatattgtgtttaaattatccataaatcgttcgaaaaattaacggatgatgacacgtattttcaagagttgaaaatttgaggtacgtgtcattagtgattaattcctaaatactcccattcgatagatcatcatgaggacaataattgatctggacagatcgatacacagatcgctttccttcgtggatggacaagtctcgaatcgacagtgtggagacactgaagcgaaagtgtaggtgcttgatagagatcaaggatactaaacatgactaacacgaaaagtcactaagatgactgcccactcgtcggtgacttgctcaaagttacagtgtaaatagttctttgacttgcggtgcctcggttgttcacagtaggattgctgtagtttgactgcaccataactcgatctcctaaccattcggagccttgaggtgtatgttggctatagtagatccattgtaggaataggatgtgcatcaaaataggatctgccgaccctgatagataggaagagatcctatatagtttatgaaacggagtcctaaaatccatgatcatggtaggtgaatgatggaaagaaattttcataagatttcacatggactcgagtcgattgaatctgacatatgacggacgaacggatttgatgagttatatccttgacctgcgtcttgtcgggactcacaacggaagaatcgaactgcacctaaaagttcattattcaattctgatggattgccactacatactgttaggtgtcactgatggatcataagactaattaagaatcattttgataagcaataattcttaattggctgaattagaaagagttctgatccttcgaaaagagtttcgatgatgttgatagagatcacaatatatctcactaccaaacagaattggacctatggggtcacacaaataaggattttggtctagaattggactaagtgtagtctgattgggttaggattaattaaagtctaagctttggatttaagaaaaccatcctaacacatggttaaacccattttttcatacttgatttgggttctctattagatagagctcaaccaaattgaagcgagctcatttaggacaccaagagttggagttcctaaagaaagccacccatgtaagaattaaatgatgggtgttttcttcggctagatgagaggcgcacacccacatggataagatccatgtgtgtgccgcctacttggagataagggagggagaaagggggataaaccccattctcttgcagataaggataagaatgaggaggttacatctaaattcaaatttgaatttgaatttggattcgaatttgaagtatttgaattcgaatctgaaaggactgagttgggcgacaactaccctatccgtggtgtacaccaatctgaatttctctttggttttgtgcgacaaaataaggtgaaaaatcaggatgggcgggcagcctaccagagtccttttgctttaaggcatttgatccaatcaaatgtctataaaagagccccaatcaaacggtttgacaatttttctcattagaagaaaaatcccagagccctccaatcatatccacgcatgttctccctcttctctctgatctctcatcctctcccatgtccaagggtgttgggcagcccatctgatggtatcgaggtgtcgagttccatccgatatatgcgaaggaacaagaaagctacaatcaggctttgatcggaaccctgtcggagatctgattgaaggctgatccagaagcttgtagatccatctaggagtagatggatcgaagatggagagagcatcctagtccgagctcgagtgaatacctgtagagatcgagcacgttcgcggctcaacagcgaacctcaaatctacgatcatcggattgcggagttcatttacccatgcaagatgatgatgtgatcatcattaatctcatttaaaattgttttaaatttctgatttctttaatctagatgcatgatcgatctaactacgatcgagatctgatcttgatcgaatcgcaagtcggatcgaaatatttttgaattccgctgcaccctgatctgatcgatcggatgtgcgatcattccttcataatgttcattattgataccccactgactttacatgccttgaactaatttggatctcacttaaagatccactttaatatttatcagatagattcctaggaccagagatatttgtttaaaaggtttctatcatcaattgggccattgtagccgaaagaaaagatgatgcattagtccagtcaggaacaataacttcttaagtcccatgtataacattaatatcaacttttctttgcttccgtctgtgttgttaatggttagatgaatagtagctgaagtttacctagctgggtgctgcagacgatcccatttcaaatcaacttttgtaaacagaacccacacatgtccattaactttcttgcaccatcaccatccatgtcaagcattgctccctgaacctcttgctttattcatcaactcctttccaaacacagctagctccttaatctttgctaatgtgatggagcatttgaggttggatcaccacagctccatactcatgtcaaaacacgggtaacagtagattttcttttttttttttcaacacttgtatgcctcaaacagttttccttcaaaacaccaattttgttacacatggtcgctcttaacaacttgatataagaatataacatcgcacaaacactttttatcaatgttcgaaaagactataagcagaaaacatgcaactgctaacctccgagcccatagatgtctggttacaacctccaacaacagcccccccccccctcccccaaaacaaaaaaataaaggaacccaaaagaaaaaaaaaaaatttggggacaaagtttagtactagctgataaattgatcatcgtcataccaagaaacaaaatttaaataatgacctaataataaaacattactcagatacatataatctacatgcatgttaagacttacgactccaagttcaaatcctgaaaatagagtatttgaggtacactttctactaaatagacccctcctccttaatttatctcccagaaacctcaattaaaggtcctttaaatctacgaaacattaccttccttttggatttcttgacgtaagttcctaaaatgattccaattttctagaattcgcgagaatccatgcttccattcaagcaattactgatcatcgattgcagtccatgagcaaatattccctctttaactcaagaaagaaagaagacagcccaaaattgacaatacagactatacacttaaataactaactaaacaatcccaacaacataataaatcttacaataatgcttaaaaatttgtgcataacttttgggtaaaattggctgaaacacctgaaaccagactggaatctgtcagttttggtcaaacaaaatcaagaaagccaaaactaaaggaaacaagggtcaattttgaatcaatatcaaccagaatttaaaatctcgatgccacttgaccaaaacctatagtaaagtcattcccaattttgaacactgatacatactaaatgctaaggatggtaactaacagactaagtatgcaagattaagtatctcagatacgcaaccaataaagaaagaatcatggtttacaaatttccctgaaacatttgcttcataaaaacattctgtaatctgttacttcaagtgaaagaaacaaaattgtcccaatcattgaaaaattgtttcagatgtttcaataaaccacatcaaattcatccaaccatcattattttaagcaaaacgagcaacccacaaaacaatttcaataatgacaggaccataatatttgagttcaaaaacttaaagaagcataggctaaaactgagagtttaatattggaaggagaaaaacgaaacttggttgtttaccatgcttaacaacattacataatgatttgatctaatcagttaaagacaataaaaagaacaaagcattagtaaaaatagcattctcatgcgagaactatagtttggaggccgcatgaataacagataaggagaaagataaaacagtacagaaagaaaagaagacctatctactgtacacaagaagaaaatcttgttagcgaccttagaagaaagggagatgtctttactgtacatgtcctgtaaaggctgcatgctagccaaacttgtcatgtttccaaacccagcaaagtgctaaagtaaacttcctgattctatacgttattatatactaaccatatcatgaagataacaaattttcttcctgacaaacatttacaacagagtgaagaaaagtatgccataagtatctgtaatatcaaattaaacactgaaaccaacaatgaaatttcaaaaaaaaaaaaggtttaagaatttaattagccatgactttggatggcaaatgaaatataatgggcaaaaatgataaatatggtccaaaaaatctaactaaggttagcttatatgtggacttggtgccaaatcaacaaccttaccgtaggttgtggcaaataaatgatttcctattctacaaagtagtcatgcacaaatacatctaatgtcaagaggacaacttccaactaccaagttcttgggcacagatttctgtgtctcatttcttaaaagcttacttgctcagaacaagcaacgagaccaataataactagctgaaaagaccaacacaactcataactttatgctaaggcaactaaaaatcaccaggcatgtgcacataaccaagcagtccatgacgtatgattcaaagtttagccaataaataaaaaaagaagaaaagaaagtaaagttcagaatagaagccacaagccaaaaaaagatgagtttgtttataagcagataatacagaaccattagggttcacatgtatgatcataaatccaccaatctctacagtcataagcatacaagccttttcaacaaataagcctattatatgtccttttcataaacattgcactgtttacattctttagtgtacttagaagagagtagttcctcagcctaatttatactcatcctttgagtaggtcccataaaaatgggatcgttcagcacatggtccccacctgagagcacaatacatttgcaacattcaaatccaaaaaccattttttatttcaggtatggtcttcatctcaaagacaaccttcacaaaattacttggacatattaggatttccaagggcaggcttcattcttgatggaataccctagtagattaccaagaaaaagtgtttgaaagaaaaaaacaacaaacatgtcagatcactaattagaacacttaagcatttgtttccagtaatattaaactatctacacttggtgatgagcttattaatagtcatattatgtcaaatattgaaaggagaattctccttgagagagagagagagagagagagagagagaatgacaaataagaaactacaataacaatgactaattaacaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagagagagagagaatgcaaatagaaactcaatacaatgcaattacaaacacaaggttcaaaagaagaaaaaaagacttagcatgcttatgccccaattgattgtcctatatagatgaagcagcacttgacatttgtggcaagcaaaagactttctctgatcttaatgattagggagagaaagatgaaagacagaagaagcaacaggcctgaaaaagcaagcagataaaataataaataattctctttttgacctgatgttaggcaaggataagcttctactttgccaaagaagaagatacagttttcagagagtaatgtgaggatacacgcacaaagaagcagatcttgtgacaaaagaggtcatgataagaattaacgaatccacaatgatgtggagcagttaatgctcatccaatttatttaacataacttccaatcatattcttataaaggaatcaatgaaagagaaaaataacctttagttacaagcagaacattacaaatttgtaggtcatttggcaatgcaagaattacaagggtcatgcagaaattaagtcagacttgttcaaggagaacagtcctttttaacttctttacattctcaccgatcaccataattttttttcttcgataactaaaaatcacattagtacagccccataagttttctgcctttcgataataaggactaagatagagtttaaaatttcgcaagaaatgtgggaaaggtcaatgtaacagtacatccaattcctagaagcgaaaaatagaagtgaacacatagaattgcacctggaaaatgacatgccatggtaaaaatgaaaagaaaaaacctaataagctaagtaccagctacaagaggactttcataagacccacattcttgagttgttgttaaaataagcttgcaatcaatttgttagtaagtccagaattctaagtgagataacattgtcaatgcatcagatctttaaagttatctactgtatattgtggggactgccgacataattggttcaaatgattgtccaacctcactttggcctaccatttgacagaagtaactaatgttatatacatcaatcaggacactttcaatgttaccatgcataacttggatgtatcctgtaccaagcagggttttaaatcccgtgggacagggcagttccaattttttcatggaacggaatgcactgccgtcctgtcccgtcccaatacttgggatagaggacgtcccaatcgaagcgctggaacactagtgggacggtcctgtcccaacacatgggatggtaccccatccaagtgtcccactaggacttgaatccttcgtaccaataacatatggtaggccatccaagtcattggatcaacactgttcatctagttctgcatatcttaaaacacatgaagtgaaaatcaaaaaaaaagaactagatttttaggaactaccattccagacaaacttgagttttattacttaattcttttttacttaacaatcatcagccatttaatctccaaaacatctgaaattttggacattcatgatcaacaatgtggatgattgatttcaatatcccatcacattgttttatgatacccaagatgaagtaagtagatacaaatatataaaaatgcattagaaaggggggaaaaatcaaaagaaaggctcagctataatttttgccatgctatggcctacatcagatgcagaagagcaatgagatgtcaccttgctttttacattgccaacgatatcagtacaaataagtagaaaaatacttgcatgaaatcaattgtgctaccttataccttctcaatcagctaagaaaagatactgctgatggacaaaaatacataatattatcatgtaatagtacatatataccattttcaaatgtttaataggttatagtatgtcaagccacatatatgtgccaaatgctgtgttatgcaacttttcatgcattgcactttgttttgattaaaacatgcatgacaccttataacctttaaaaggatgaccaaagtccaaaatcactaatcaagaacatagatcagaattgtgtgaagagatgcaattctttcaaccatcaatccatgaacaaaagaaagcactaacagcataaccacatgcctgacaaatccataagttctcaatgtcatgaataacgaaagcaccttacattattgtctttacatatataaatcagttgctgatgataaatagaaataaagagaagttgcataatgatatacttttcaaggtggaaaagtatttgaatgatgatcataattgcatcgataacagaaaaggtaactacataagaggtcctgctcttaagcacaaggaagagcaccaagtatcactaagccatcaatttttctgtactgtcatagtctcgattccaaagaaaattttacctggcctccttgtcaaacccaaagcgagccccaaaatagaatgcaacagccaacaaccacgcatcactgtgaactgcaactagtgacagccaatccttttcatccatcccatccctggcaaaattaattcctaatgctggctcaggaagctctggaggaacttcctcggcaggcaaatttacttcccaggtctcattgggaagtccataaagacacaagttctccttttctgccaatacaataaaatgttcagtatgaaatatcctcagcatgtaagactcaaactgctgatagagtaaaggattctccagttacataaatcacatagcattcaataatctgtggagaaatatgtagtcgattgcattgcacaaatagtaattacagaaaaatgcattaagtagccattgaagtaactgaaagaattgctactcggtaagcagcagagataatgttttttttaaaacggtcattacacaaaaattggatgaacaaattatgacctgcctacttctaaatcttgtacagtggaagttatacggttatcaatcacaagagaggccttttaatcaaatatcatataccataaccaacaatccctatacacaatataaagaattgtcttaaagcaccttctttaccacgcaaaactccatccatgatctccggaaatgcaaaggcattaagtataaagactgagaaagggaaaaaatatttcagtcccaaacagctacatttgattggacgaaacacatgaaatattatccatagctttcacaatatgacgtaacatctaaaggggccgaaacaacaaaatttgatctttcagcgtcagatcatctgagaaaacaaagaaatcaaaagaagacctgttaaaggaggtgaaaatgttctaataccaccaccggacctaatcgaacaacaaaaccataaatggcggaaccctaacaccaacggatcgaaccaaaaaaaaaaaaaagggaatgactcaccgggatcacatagctggtagaacttgtcaacctctgcaacaccagcaacaaagacataaaaaacatttttttcagaaaccagccacaacacaaacaaaccaaaaatggaaaaaaaaaaagcctcaaaagcttcaaaaattcgagctcaagagtgggaaaaggggagagtgtatgagagagaagaaaggaagagaccggtggtgagagctttgatcattccagctcgccggcctctaaaatcccggaagacctcctctgccgtacgagaattgtacgtccccgcagccccctccatttcccacgcgatagtagaccaggccggtggaccttgcgagcttcaatggcggaagcgagcagggatttcgccctggaatcgcagaacaccaattagacttcagagagcgagagagcaataaattagggctcccaatctctgtcgagagattagggtttccgagagcgttttcggccgaaagggttcaaatcccagctcgatgagaggaagaagtaaagaagcaaactacagagagagaggggaaaatggaaggagggaaggtagcgcgatatggagggttttgtgggtttttatttggtcgggagggttctcattcgttcttctttttcgttttcaggcttttacttggtcctggtggcgtcgggcgatgtgcggtcatcttaccggcctcaaaatcgtagccttgaactatcggaaatgacttccatgtccccgccaaacggaggtggcacacctatcaatccctccacgattcccatcccatttggatgggcatgtggatggcacgtggcaagcattttgtggcatgattttatttttttgttttttttttttgggcatgattggtgcatgcttttggagcaaattagatgcaattcaagattgaattggtgattgctcatagtccttgggagcggtcttgatttgtggataattgcttatgttggcaaattgaacaataaagataggttaatgttgcattaagacctaccacaggatgattatataataaaaagtaattttattgaaaataataagaaaataaaagggtagccatgtaactttattcagtgatgtgtgtgttttatctaatatttttgagatattttttgtaattttttatatcattcttattcatctacaataaccatgaagttaaaaagtaaagatttatctttaattttatatacatatatatttattattattataataatctctagcactgaagccaacaaaaaaataacgagagatttattgtgtgactaatgcctccacatttctattgatagtcttgattatttatttatttttttattagatcgatgatattaaaaaattatatatacacacacgtatgtgtgtacatatatattatgcctccaaaattttttaatattattttgaaacttttagttttatgttgccaacaatttgccctctatatctactaccgtgtcaatcatattatatatattctttgatttagcaaaaatacatcatgtatgatttttgtttgaatgattctgaaaaaagataaagtcaattttatagcgcacatattaacataagcatagcagttgagatgaatattttgatcatttacgaaattttaaattttaaaatattttaaaaaaattaatatatttaacaatgtatatattatatcatgatagtatatattttatttttttaattaatatgacaatgcaagctaggagaaattattagacatgcataaatacataagcaaaaaatctcatgtacatattgtgactcgcaaagatccctctgattatggtccttggattcacgtcaaatcagaataatgagagaggcaagggttagtttatgttatatttttgtggttgttgcttgcacattattgacttgtttattttttttttcaagttataaaacatcagcaacaaaccatgtctaccttatttatgacaagtgaagcctctagataggggagggtgccccacttctaccatgtctgtttcctctttctcattgccttcatcccctcgctccagtggcgtaaacatctctccattttttatttttttttttctttggggtacaataaacgaacattaaaaaataggtggactttgcgttaatatttagtgtttctgtggactcaaatggaatacttggctgtccccgtcctctgtccgtaaataatcattgctgaaatataaaatattttccaaatcggatcctattttttcattaataacaaacccttggagagagaaaaaatgcgaagaggtagaatttacaaatataaaaaatagacgaggttctagttgtaattaaaaagataattccaatcgagtcctccaggaaattaaacggtctaacatttcacactttcgtccctagcctctctctatttgtttaccaatcgttaccatacgcttggctttccgccacgaggactcgggaagtttctgcattcgaggaggaaaagggggcgggatcgaaatccaaacgagactataaaatggacaacgatccgttcttgttcccttcgattagagagagaaggaagagaagaggggagagagagagaggagcggcgaaggggagggcggcgatggctccgctgccggtgccggcgagcgtcgcaaagcaggcggagcaactgaagcaagatgggaacagctacttcaagaaggaacgcctgggggccgccatcgacgcctacaccgaggtatcgtttccggtttccatttatttgaaggcgaaaaacgatttcgtttacccttatagattctttttttcttttaatctattcttgcatccggttttgttcttttgattccgttctcgtggttcttgaagccaacattggctgtttgatcaagtgtcttggtaaaattatggatttttctccctcaaaactatctgtttttgatcaaaagaagaaactttctctaaccccaagtccgaagttcatgtcttggcgctgtcctcctgctctaatcggcttccttgtggtgatcgatatggatgtttgattggatgaattgggttttcaggcaattacgttgtgcccggatgtggcgatttattggacgaaccgagccttgtgctatcggaagcggaagtatgtataagccaccgttttcacttcttgttctttcttgatttgttggattggttgtctcaatggatgttgggctgttgtacttgtcgagtttgatagtgaatggaaaaaagtcgaagaggattgtaggagagcacttcagctcgacagcaattctgtgaaggtaagcttgcatctttcgtttcctccttcatccgttctctttctttgcaatgtttttcctattttttggtatctgctgttgaaattctgtgaactacataccttttttgacaatttctggttatcaattattgttttgtggtttcactgttgctttccgtctgctgattactcgtcatgtcattgcctgtttttcttgaattctgtgtttgtttgatctattgtcacttgaactctgagcataggcagttctggagcaacgtggtcaaagattttaggtacaaattatctaaaaatggatttttggtcttattggtccttttggccaactaagtatgatgctgctactaattggcagtttctgcagtgtatcatctcatggtaatttaatctagcttttgcctttaatcactgctgatcatgttaatctggcaggctaagactttttcatgtgggatgtctccgatttcttacttttctaagctggctgctgtgttgttttgagaaattatgcatgaatatgctttaatacacttatcaatgagacatgctgagtgtcacatccaccatgcacagttgattcactggatgcacatagactcttgccattggattggctttcgttagtaacatattccattgtggtggttctgtcatgcatttttgaattctaaagcaataacagtccagttaaggaaactaaatgaactagctctaggttctcattctagggaatcattgatgtgtttagcgttggggataggtggagaaataaaaaaagtaggataaagaaataatgagggatgatcaaggaaaggtttactaattaaagttcttttttcaaaagagtgatttcccatggttgatgcatacaagcttggggaaatcccatctctaggatacaatgccttgcatgctcgaaatctccaagggctcctctctagggacgttgctgatgaaaaaacccattctggaaggagagaaaagaaaataactttaaatcatagaggcacttgattttttattttgagggggagagagaaggttcaacgttgtaatgcagccatccacctcccttaagaagaaaagtgtagttcttcatttttatctttgtttataaataaaaaggaccattctaaatgttaacccttttcccagattctgtgcacctgaatgacattccacttggccaaatcaaaatgtcaatccaaacctgcttcaagatttaaactgctgaagaccatttggcagtaacttgaccccttcgtcacctgttttggagcttggattggaaaaagtgagagcctcccagataggcaaagctctgccacctctctccataccatctcaagtgaaactaatacaaaactcttaccatggaagcaaaaccaaaaccatgtgaaaacatctttcctttatcatcttattcttatgatgcagtaactctactatggaaacatctagtggatgttttttacttgttgcttgttggtatttcattgtgattgcatgcatgtatcttttgttcaaggaataataattggagtttcctgatttaatcaaaacaacatcatgtttttgttaaagggagtcattcttatctcgtgcttgtgatgagagccatataaggatcctgttatgtagaactagctgattttagttggtttcaaacaacctctaggtcctctattgaatggctgaaactcgaggagtaggtctttgagtcgaattgtgcttggcatcaattgcatgactaacattttgagtgcaccatatgcatggtacacatgtatggactctttgtatgcagaagcttccatagtaaaaaggtgaataaaaatgcatgatggacagcatatgtggctgcaatatatgtacaatgaagttaactggttaaaatgcacaggtccaagaggaaattaatgaactcttgctttatagatgtcagaaattatgagtgttaatatgactttgagaagcttgtaggcagaatatatcttatgagtctgcaaaagaaaaaggaggcttcaaccacattggatgcttaaaggttgaaggtgtaagaaaatttggatagattacttttatgaaagttttggatggggatttgcctatatagcagagtaaaagggtagcctaatatacaggagccattgcagggtttggggagggttagatgtcagcagcctctccaaccatgtgttgagaggccttttttgtgttttgaacatgcgacatgtagatcacaatggagcaactttaccatggtgccaaggctctcttgcttgtagagtgagatggagaaatcacatatagtattgttggcattggaagagactttaacaatctatttagtaggattcaagggttctggcaatctttaggaccatatgaaatgtgggtaaaaatagggggactatgggagatattgcttcactatagagaaactaaacaaaacattgttcatttggattttgggcataagcagttcatttttcaagacctcagttcatttgtgtcttaggaaaaggttttcatggttccactatgcatttcactgcaaggaatcgttcttatgagttagattaatctcaagaagattttaaaacaataacgattcccttaatagcagttgatctttcaatgagtaagtgctatctgaccttgaaaagttgttttcagtagttctattgcattttctttattctcagtaagcagcactatgctacttaagcatccaactctggttctcttttatgttctgctattgggagttgcaaataatcctgttcctggttataattttactggttagaattttgtgatatctgtttcctagggtaagggccctttttatgattctattgaagcagtaacattgtactggaagacattgctagatgcctcaattgtttatcggctttttcctatgtgcatgctgtgttatggttctattgtaccctgacacgttgcagcttgccaaaaatattattctcataacctgtatgttaatagaattcttttcactgtaattgtggtatgcatctatctagtattctagttaatatggtatctgttgtttcgatgactgagtcgatttctttcatggcatccatatacgcacttacgttggggcttgcatgctataatattgttctgttgtaccctgataatatggaatttgtcatttccatggctgagtggatttctttcatggcatccacaggcacactatatgttggggcttgcattgctagagaaacatgattactctgggggaatcaaggaattggagaaggttagtaattctatctaataccacggcactctaaaatacacgaggatgacagtgcattgccttatgtttggttaaactgctattatcttgcaatgcgaattctgttaaccaactgaaagcaaaagaatactaatcaatttgtttgccaacatcattcccatgcagcaaactcagggagcttaaagatagactacatatttggtacttgatcatcagccagttacacttctgtggagttgccacagaaacatgtaacttaaaaaaaattgcacaatgtggaaatcatggtgcacaatttctacaaacatataataaagctgttgaaaagcaaagttagatctacttactataggaactttatgcaagttactttgcattgcggaacatatggcttattctgtcagaatggaaatatatctatctatctatctattatgtgtgtgtgtgcgtgattatatatatatatatatattatttatttattttgggttgatattattcctactagtgttgggcatgtgcaatgcatgtgaatggaaatggatggttgtgttaactttatttgattagatatcctctattatttatgtaattatgttactttaagaatgcaccacttttggctggtgcacttttcttgtttttctctcatagtgatagtgagaaccaaaagaagagggatgtatttattaatttcaggatcactgttaaacatgttggaattggagatggttgaacatccagtccaacatctatgtgggagggagtttgctttatattatgtctaatgcagcaaaatgacatcaactggtgtattttgccaggtgaatgtgcaggaaccaatttaattattgataattataataggcttagaagttcatcaattgatagaaaaatcatatttgacttggtgaatctgagcaatggtgagtcagtaattttaacttaccaaccaaactaccactcaccttgtttggccagtgcatgacatttgccccccccccccgcaaatcccaacagaaaaaaaaaaagaaaaaagaaaaaaaagatttcatcttgcatgtttgaagcagttttaattgtatcttttcatatggtttctgtcctttgagccaatcaaacttatacagtggaatacatgtcaagtctcggcaagaattgccaaatcatgaaaatggattgatatggctgagacttctccaatgtctcagctcaagtggtgtcttattcgcaactttgtaattcttattaacaacttgaatgttgtttaacggtgccatgatcttgtatcataaagttgtgatggctgtcattagaaggtggtgtttgttactcaacagttctggttgatgtcattaagcaatcagagttgctaatgagatatcatggttctgtgggacccggaatctattgaaccagacctccccaaggtaccaccggaatgagttattagttccttgcttctgtattcattcatgcagactcgcccctccttccccactttcactagagagaaaaaaggttccactttctccatgatgagtaccaaggtttttgctataatctagccagcttagataagtgatgtgatgccttgtgataatggtgaaactgaaactgctggtaaaatcggttaagttagttacggatttgcatgcagatatggaggtatctctgactctttgaaggtcaacagctatagaactcaagggtcatgctcgtcaacactgtgaaatccttgccttaattttctgctttttcattagcaacagaatcttctgattaccaatcttgttctacctgtcatgcatataatgtttaatgagctttatctttcttcttgttttagcaagtcatgcagatttatgtttatcattcacgtctctcattttttgtatcgtttaaacatcgcttgggtatctttgtcaatttcctataactaaagtctgtagaacttatatgagataggctttggaacttgggagaggtgctaacccagcaagctacatggtcgaggagatttggcaggttctttccagagcaaagtacatggaatgggaagattcatctagcaagcgggcatctaggctgcagaatttgaggtatgtatatttttttataagttgctgaaaaaggtccatatattgatctcttttactcaatatattaaagaatgcaagcatttgcatctattagacatgacaaaaacttgtatcgtatttcagggaagtatgtgaaaaagctcttatagattattatttcatcgatgcatctgaagctgaagatagctctaaagaaagtgaccattcccaatcccagcagttggaatacctccgtgaggtgttcaacaaagccgcacaagctgatacaccatcagaggtgagccaacttcttattttactcaggacgaccttttttcccctttcctttctagcaataacggttatcataatcgttgatattcaggtgccggaccacttgtgttgtaaaattacactcgatatctttcgtgaccctgtgattactccaagtggcattacttatgaacgggcagtgcttcttgatcatcttcagaaggtgattcctagtctctaccactactcagactccttgctttttctttatgtctatgctttaagttctgacatataatttctcaaaattaggtgggcaagttcgatcctgtcacaagagagctgcttgaaccgcaccaattggtaccaaaccttgctatcaaggaagctgttcaagcattcctcagagaccatggttgggcatacaagatgtcctaaatgttctgattcctggaccctatgatcgaggaggttttacatggctatggttgcgtgcagttgcagcttttaaatcaggattttgtgttgtattcatgttgttacattttcttcagtgtttctcagccttttcactaacctgtgaaaaactttgttgagtgtccgtgtacagagagccgattttatgctttgcagtacagtctgatggttctttatgtaaagcccatccttttgggtaccatttatacagatggatagaaagctttggattggcaatgagcatatatagtctcgggtgcctttctgttttcattcgccacggattttgcaaagctgccaacacttcttgaaagtttgcaccactactgccgttttctatgatgcttgcgttggttctcctctgctctgaatcattccatacccaatggtggattgtgggggctctcgtgtgggtgatgaatggaactatgtgctgttgagggaaaactgaggctcaaggaacgtaaggcagacaagccattgtaaagcctctgataatatgataatataacaacatagcataatataatatcatatattattattatattatattattataatatataataataataatataataatatagtaatataatatatcatataataataatagttatataataaagggtattaagaaaaatatggataaattttgataatttattcaaaaaattagtaatgcaaaagagtcatgtttcaatgtataaaagaacgtaaatatattattttttatgtaaatattatctgtaaaatatttattcaaaaaatataaatttttggataaattttttttatccatagaagaatgggtcttgagggatccttgaatctttgttcaacttctcttaagcagcacaaaggaaagacacaatcaaaagaataaatgtgcttggagagtccaagacgacgaagtggagtgcatatccaatacctcccatgctgctactttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaagggagtttgaacagctgcttaatgaacataggtttgatacttctctcattgtttgagctaattgatgcatgagaagagaattgcatgctagagaaaatttgtaccatttgatgtgctgcaggttacttggcttgactggtgcatcccatgcatggtcaatgtaaaattcaaaacatggattttgggtttatactttatcataagctaaaagaattgccttagatataaccatcttttcatagtcatgtatcatacaaggggctaattctcagtgactgtaatttcaataaattattttctgctactttgttcatgttcatgtttctctctatattgacctttattatggtcacccttgatctctgtttcacatgactatgccatcttaatttatttacataaacatttttgatgtagctctttatcttccacataatatttatctagagaaaattctagtgacctattattttatgtgtgcactggttttgtatcatctttcttgttctttatataggatattttgttgaccacataagtggcttttgtacaagaacctacagtcttgtcttcttcatggtattcacaaccttagtaaacatgtttttttggtttatgtactatttggcgcaaaagggccaaaacttgcttgagtttcacatgtcaaaggcaatattcaccatctggatcctgttgataatctccaccatggaattcaaatgtagaccctatcttcaaaatgttgccgaattactgcaacgaccaatgccaaaattaggtgctagataacaatcaagaaggttgcctgaatgtgaacttatcttaattgtttgataatgccactgcaaagttttatatgggtaaaagtagttggtaaacctccatgtgaaaaattttgatagccatgtggggcttctattcaagttggtgtgcagtggtgaggtttatgttgttggggagttgatctgactagtgtttgacttcaggcacatgctgagtatatcactagctaacttcaaatttgagagccctgccccaagttgatctctttaaaaaaaatatatcatgtgtctgcagaagagagttgtaaagaatatggcatgacctgcccaaaattccagtagataatggagtttattgattacatttgacagaacactgggcactgagcatggctatctggagtgacaaataaagtacaccttagtgaaagcaatggaattttggttttcaaacgattgcatgtgctaaatgtactaacctatttttgatattttaatcaacacttttctttgtcctttgctacttttaatattaacaaaacataacatatatgtgaactttttagtaaaagatatatagttgactaagtaaagattgttcaatcgtacaagtatgttttatagctttgttttgtgcagaagtgtttattgttggaggttaaagtgttggtgattttaggacacctgcacacttaggacccatgccaatcctccagataatatttttcagacaaggtttttcaaaataagaagcttaatggacctattgttgggtacataatgaaagaccttttgtccctatagcatcatgagggacagaatggaagaaattttgcattccaggggaatatggtttagtcatggttatctaatttgctagaacataagcaagttgaggactggtagacatataaccaatgtgcaatatggtttgatccggcatgaaaaggagagtgaattagatagtcaatgcgaaggttattcatttaattcctaaacattctaattttattacctacaccaagcaaatccactcactagaaaatcaacaaattgcaagttgctggccaaaaccaagtaaagcaagcaactggtgatgatggtcttggaaagaacaactaattatgcccatcaaacatcaactctagaaaatggattaggaaagggttttacttttgtcatgaataagcagtgcatgacataattttccaccaatttgcttatcatcacgtatggtatgttgcctacatctattgtgatcctcacgaaattgatgagaatggaccagaaaccaactaatacatcaatataggtggtttttttttaaaaaaaaaagaattcatatttttgtttgtaaaatacaatttcaatggcatttcattcatagcgtatcaaatagcacccttttcaaacttagaagtcagaaacctcgctgtgtttttttgattacatgtaacaaaaaaaaaggaaaaaaattgccaaaatctatcaaaatagttgtcatatatcctaattttattctatatgattttttttccaagttccctggattttttctcttataagttttggaccaacttttagcattttaattcttcccactgactgaaatatgctctgatcttgacttttcaaaccttgatgctggattaaaaaaatgaccttgccggtcaaaccacgtgaagcaagactcttctctcaattaaatatcagccttgtaagtaatcttgttagcttcaacattaaagttctcagacatgacttaaatcattagaatattatagcttgttattctttccagtatggttacagaaatcattaactggcatgtgactgctatagcttttttgatggttttgtgtgatataataagctgttattgtacgcttctggttacctatgtgaacaagcaacctaacatcttgcacatctagaacatatgctgtgaaatataaaaataattgatccgtgggctattagttttgtatcttgcagtcgaacttttatgcagaaattgtccttttcggcagtttttctgattcaactttttcatcaaactggcaggtcaacttccatgcaaggaaaactgctccagcataatctaggccctgaagtagttcatgcactcaaggatcttaagaaaaagctgtctgaagaagaatccatgtaattaactttcccagtgggctccatcgcatacgaagctggttaatactgccaataatcacatgcaaatgcaaattggaagctcaaacgtcaagtgatggatcaatgacaggggggatgtaactaatgagggcctgtttcaataatcctgttcaggcttccatttattaatcagtattaggatattgggatgcttttgttgattgttttcagtttcggcagattaagagcttacaaggctgggaatgtggctcttaaaccatgaatttctttggcttttccattatttgttgtttgtattattgaacaaagaaagaaagcagttttctttttttttcctgtggcgaatattgtgcgactgttgatgtttcctcattttggttgcctgcatcatgacgatcttattatctctctccctctcaaagagattgcggtaatgatattttttgtataaatgcaaaattttgtccctgcaaaaccttgaataaagcttaaaagttattcagggcagctgttcatcaattatgatgaggaaaaaccagcaatgcaaacagttctaatgatctcttggaagcccgctgttttggatctcaccaaagtccaaaagttttaggttgcggcctgtcttgaatcagcatcagcacctttcaagcggttccatgcatatcatgtttcatgtggactggagcgttctccgtaactagccttaatttggttgcttgtgtgaaagtgattgatgtatcagatgaaagcagccttggaggccagattctcggtacatggattaatctgatggcagacatttgtgtaacaatgagactatggcaaacaaggcttggctttttgtatgagcaaatccaggtttgaatcaccaccaacgttgtttcattatcctccacaattattgcaaactatgggtgaaatatttttccatatctccaccttttctttgagtaagcctattaaactatgtgtcagattccttccagatatcaaaatgtcacctacatgcaggcaaaatagaactgaactttttgctggttttgctatgaatagtggctactgctaagcttccatttgtgattaggagttttaatacaaccactgctttactaatttgcaggagatcaacgtctccaagattcgaacctcctcaccaggcatcctgagcttgtcttaaagatcagcttgacatgagcccaattcaggtttggtaggaagacaaatgagccgaggttgaacacagttcacaggcttaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagccaaatttgaccttaaattcaagttcaagaacaatcttgaacatcctggtcaagttcaaacaaacaaaaagcagcatgctccatcttttcagctaatcatgccatgtgcgatttctatcttatcaaagttgtcaaaaccaatcttgctcgtgccactagattgctccaagttgatgttctgggtcacatctagacaatctaaaaccatgagatctttcaaatggagaggaaaaaaaaggcacatatggccaagttctgatcagttaatagctgtcaaagaaatcttttttgttttcttttcctctgttttttttttccattgtgaccctcgcatcatcaagaaagcctcaaacaaacttagaaaatcctcctaagatttcaagggaaaacagtggggaagaaacacacactagagtgatgtttttctgtatgccagcgagtgagaaagagacttttaccataaaccaagtacaaaagatggtgaaagcctaagatgcgagagagagagcccacccaccgggtgttcacgagatccctgcccaggtccacggcaccgggaccgtcccagcccctgcccggcacgtgccttctcgcgcctctcacgtgacatccagcatcgaccgaagagacaggcaggcaggcgagcgactgggccagcgtctgccccccagtcaagaggagtcaacggtcaaccgtcgcggtcaaagtcaaagtttccgaccgtcctggtccgaattgaatggatccaacggtccttgcggccccatctcgatcgaatcttcccttgtatgatctcccaccattaaagcgggcggcgggtgcaccaaccggaccgcccactgtaactgccgtcgctgtgctgtctccacatgcactctcggagggcaataacagtacaaggagagatatatgcatacatcccaccgcaggaattgaatgctttcgatcgccacctctttgagttgaatgttcttcttgactcacaccagggtgttgttatgaatggtgtccttcttgtatcattcctatgggcacccatctcaccgaagctataaagaagcgttgcattaatgttcgtgcacatgtagtcatgcagtagttgcacatgtacgtaatatgcaaaatgagtgcacataagccactgagttcaccgttttttttaaaaaaatatttgcattatcttctagtgtttctttttttggtaaaccatttttggatggagaattctaagaagttgaacacaaggaaaggtggtcttgcatgaaggtcgagaaagtttatgggcattacctcttttatccgaataatacaattcatattaattgttagggggatgttactgtgatgtctggcatggccacagtaatcatataaaccctgtaattctttgatccaaccatgcatgcatgcatttcagataaagaaattataaaaaaaaaaggtggataattaaagtaatctttttctttgtaaaaatattattgtaccatttcttttgttcttgagcaggtaaatattgtggttactgacttctcatttcagtttggtgttaagtcggaagagacacgagcagatttgagagtggtttttctggtacattgccatattgtctttatagggcaacctcatttgaccagattaatgaaaatttctctccacaatacttttctttgtacatttagatatttatgaattcaataaatttataaatatgaacatcagtagaaaagcatggttaatattggagtgacattctaggtaaaaacatcgtatggttctaagtggtaagagataataatgaaaatttagattattattcctataagattctttaattgtctgcatgtacacatccatctctatatagaaatatgaaatcattaacatgaatatattttaatacaccaattcgacactactctttttctttgataagaagcaattctatgctatatgacatcatatcggactaacacatattgccggttctaatagcatgtgggccatgcatgcacattgcgtagtagaaaaaattggatgaaacgtgccgtatcgagaacctactaatgctgtgataggaatcaaatttattgatgatggctattggtcatgcaataaacactctctttattttttctaacggttgatgctgcataaattaaatatgttgtgcttgttaaaaaggagagggggtgggggttagaataaaagcatagatagcatgattttagactaatatgtggctaagacgataaatttattgttaaatttctaacattttgcctatttgcgattcatgccttgatgggtaaaagaaaattgtgatttttttgcgtgtaaaatgtaggttaaaatcatacaagtagtgaaaccggtcctataattagtacttacttgatctgcaaacggtctgtctctttttgattgaataggaggctgaggaattaaagctcagccacctgaagttttattaaaaggacaggagagacatttacagcacaaaaaggccaactcggctgagggccttctcttcttattaccttttacctttagctactaactggctgggcctgttgcaagagcttcagatggagagagagagaccatagttccttgtgacaaacggtcagaacttaagaaatactttgcgcgttttctagagacatatagttcaaatggcgtcattgacctgacagtcaatgatattacccacttttgtgctcttatcccagtattgtgtgaagtgcgggatgagacagagagcaccgagatagaggcatggtaaggtttcttgcgtggaatcacactttgtccagggtttcttgtaataaacttggattttcagaaagggggtccagccttcagaactctattaattatagtaaaaatacttcactcctgacgttgtaccgctagaaaagtttctcttattatttttttctacctttcgtttttgactctcaggagggagagagacaaagccccaccagcttttattaaggtggaggtgaattaaaaaagatagcatcatgaaacaccgtatgggatttggctccgtaggattttacgaatgagatctgtccaaggtaacaggtaatagttgtgaagttattgaaaagttcttgaaatacatcatttttttttgctcagcccactgattctctgaattttactctaacaacaacttagccgatggttatttaacaattcatagaagctataatttactcatgtctggtgcaagaacaacttagccgatggttatttgacaattcatagaagctataatttactcatgtctggtgcaagaaaggtacttaagaaccataccttatttatattgtgtgtcccagctgatgatggtgttttacatgaagaaataaataattaattgttcaatatgatacatcaattaattagctagcttacattattcatatatttaatagttttttcctaagttttagctttttgagttggtgctgacttttagaaggtcacagcattttttttccaaattgtggatctttagattagtcaagttgttctcaaattaatgccaaatttgtgactctaaacccatttgattaggtggagagtataaaaaaaaaaaaaatactggaccaatgttctgttaagtagcgacatagcatctgcacttttagaaacttgcaatatatatatatatgaagattaatatcctacttttatgattaccaaatgattttgaatttgacaacttacaaactatggctttggataacggggaagaggaagtgaaacgaggagcatatgctttacactccactcacaagaatcctattagacgggaacagaggaagcaaaaaaaaaaaaaaaaagagtataggttctatattcgatccactagaacacgaataaagagagtgaaagcaaagatcattttgaatattttttcttttatatatagaaaaacgaacaagaccaaaaacaatatatacctaatgtactatattattttggtgaaaaggaaaatattattataaactgcacattgatgagttcctatggtgatataataacgttataaatatatattatttatgaataatacaaaatatagatagccttatatattgctatttatcataatgatacagttatgtatgatgcatgtcctaactaccagttaattttcttgtactcatgacactataccaagactccgagatcactgcaccatggaagaccatacctagaagaaagcacatgcatgtatatatatgtatatataataacattgactttggaccataggtagtgcacatgttgttcaagagtttatttttaatataaaatagataagtaagatagtgtggtgatgattgatgccggagcatctagggttgatctggtggatgagtgggtttgggtcccatgatgggtgctaccctacattaggcaccaattagctatttaggaaactttatattagtgaactttaggaaattttgattttaagatttttgtttttgagaacttgtgatgtcatttggaaggttaaagactagagttatttgagttataataagatcaggaatcctatattagcaaggagaagaaaagggttaattctcttatacgacttataaatatctcattgaggatcctattgcgatcatctttgagtaattgcgtcatgaaattctgctttgaaaattattctttttgtgctcttttttctattccctctctcctctcttttggttgattcttaaggtttgcgagtaatggtgtgaaagctgtatctttggagtgcttggacaagatggtaatttggctgtggaagagagagacctgctatgcctcctccaacaatcaattttgtcgatatcctttttgtctctcttatttcaaaaccaagttcaactataatgattttggatccactaattaactcggtgccatcatatttactgttaccaacttgacaagtgggatgaagcgaatcggctttttttttcagccagcctcaaaggttggattttctagttcagacatccttcgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacaaggcaaatagtctggcttaacccgcaacattttgatgatgttcatgtctttccatatatatctgcttgatcttgcaaatggagattcatttaccagtaccaggatgaagataaagatgccagttcaagaacattcattgtcattacaatattctgacctagttctccatcatcatataatagagtcaactccaaaggccataggttctgctgaattatggaaggtgcatctatgcaaggaccatagcattggtgttggctactactgtactacaataatttagaaatcacaaaattttctttttagtcattaatttcttaccaaatcatcatttttaaatttttgaacaataatttttcaatcttttattacgaaaaagattgtaatgtttcgtcacaaaatgtatttgtttttttgaaaaccttttttcggtcattaaaatttttagccataaggtcgtcaaaatttttggtcaatataaacttctaatgacaaaactaaaagtttctgtgatggaattttcatcattaaaaatctaaatttcaatagtgttgttcatggtctatctagtcctggtcggctagctatcagaaccatatgcagtcctctgggaactaccttgatggccccgaggattctctgctagcagcttgcccccgggatccaagagataaggtagcctttcctccattaaattgccttcagtattcgattgtacacaaagttatagacttcacccttgacgtccagaagatccaggacttggtgccagaaggcactttgcggcgccgaaatttatgatggcgtcctcatgcgtaacgtgaaaagtttccacggcttacatgggcggagaagaagatgcatggaattttgacgataaagtcatgatcctatgacgccaaggttttacgaagatgtgctttgaagagattgaacagatggcactcgtcaaatatggagctagggctcccaaaatgaaggaagaatctgatgaatattaatattgtattccatggcgttataaacgggtgtaccaagaaggattaattatttttttaaggatgagaaatctttagttatgacccacaggctggtgaggtgctgatagatggtgtcaagctgaagactctcaagggaagattggaatggttaacacgcattccctctggtctgatgctactatctaggagaacattgcgtacgggaaggaaggtgcaacactggaaatattaggagacctctcttgagcttgcaaatgctgactgcccggttcattgacgtgatgccggaaggccttgatacggtggttggtcatgagcacggagtgtagctccctcgtggacagaaacagaggattccaattccgagagctattttaaaggatccaagatcatagttatcttaggacctatttttttatgaataaatattataaaaaaattatttaattttttattgatcaacttattcataaattattttttatagatcgatagcatttatccataaaatgaaaaaaaatcttatccatctagatggtggctaaattatttttccatcaatcagataaatatcctttttgattaatttccaatatacccttaaacttataattataatataatataatatattataataaatataaaatattattatatataataatatttatatgttattgttgtgggggttatcacacctcaactcataagaaagccgatctgaattgaaggttgagttcatataaaaccgatctaaattggaggctgagttcataagaaagtcgatctgaattggaagttgagttcataagaaagtcgatctaaattgaaaattgagttcatataaaaccgacctgaattggaggctgaatattgatctgaattggaggctgaatgctgacctgactcaactcagcttatctaaataccgaccttagctacctgaattgacttctgatgaagtatcatcatctgtttatatatataccgacctgattcatctcaactcatataaatactgacttgactcattttagctcatataaataccgacatgaagcagagtattacatatatccgagatgttcagggtcccatatgatacttgatttcatcccagtattttaccgaggtgaactactatattgacggccacagtcatcttgttaaagtccgctatgatctctacaactaagctacaactggctacgatctcacgtacaactgtgctataactcatccccaactggcatatacagctaagtatgatctcatttctagctaatatatgcagtaatactctagcttacttacagctggcctccaacggcctaacaaactctatagctggcctctaacggcctaacaaactcttccaacagtctcatcagtccctctataaataaagggcaaagggatccttcaggtaagtttttatttccaagtccaaagctcaaactagagggacactttgctgctgagactctagctcccacaaagtcataaaccctctagttctatacaaatcctcctgctctctattctactttttctatcttctattctcgaggctcaaattgacttaagcatcagagggtcaaagatcggagaatccccactaatttttgtcttattttgtaggattcttcgaaggagactcatattggatcaccacagcctctccaacatgacttcatccaatctcttcatctgagattttgagcctcacaacaatagattggtgctagaggaagagtgatctaaaaattttatgaaaaaaatggtgaatcaaaaagcacaaagcaactctatactttgaccgtctccctctgaagatatgctggaagctgtctcacctccatttgaaaggagattggggggtaggtgaaaattttttttttaaaagacagcgcactaacgataaactttcaataatttttttttaattttttaattcctatccataggagctcaaatccttttgtctagtcttatcaggttaaatcactttactacaccactctcagagccttaagctgtcaactcatggtattaatggggacggcccccacatcctgtgaggtgacaatactcatcaattcagaaaatcaaagggccagactcggtgctcaagaatattatgaggggcaaaaatatcctttccgaccatcttttttttcaaagctcttaaacaaaactcataacctctccgataataaattctcaagctctatctactattttattcttttgttgcaggtcaacaggttcttgagtacacgaactaaagaaaaaatcaaaacaagaataaaaaaatttatccaaacgagatatctatttgaggaaactcaagatgcgatttgagattttaagacaatatacctttgaaaagaaaaagaggagaaaatccccggacatagccgaagtcatcttacaggtgacaacaacaaaaaaaagggggagagagaaagaaaatgaaagagaggaaagaaggcagaggagggtcggttccctccacccaaggtcattcgcacaccccatcggatcggcatcttcgacactcccgtgcgcctcctggagccaagaatagccgatcggccacgtctcctggagccatgaatggcggaccagcctttcccgatgtctcccacactcctgtgcggctccaagtgccaaaacatcgtcagatcagtgacttccctccgatcgagaccatccgcatgctcgtgtacgtttgcagcaccaggccctaccaaattggtaactacggtggtctccacttcctttcttgcgctccgatgctccacacgaggcccagcactggcaaatcgatctccaatcctgcatcctgatggtgggctccactggattgacggcccccgatgatctccagctctcctccctgtgtcacgcatatttttgatcgacagtcccactatctctggctctccttcctacatctgtgggtattttcggtgccgaatccagtcagatcgattgccctccggcatcaaacatcgcaagatcggcactctctcgagttgccgtgctcctccggcatcaagcaccattggatcggtgcaatctcgagctgccacgcacctgccacatcaaatcgtgtcagactggtagttttccaaactcccatgcacctcctgacgtcaaacttgctcgaccgagatctctcggacaatcatggaatgtcattccaactccatttgcagtagtcaataaaagaatatgagagtgccatccagaacctgcaatggggccaaatagaagatttacttcatgaattgatgaatttttgtaatgacatacgcgtgcagtctaccctccgctcgaagtctgcacatgtatgcaatcttggacaatgccgaagagacccatgggtgtccccaaagcccaggccaaaattgattccaaaaaaaaaaaagaaaaaaaagaagaggagagagcttgatctccagccaaagttaaagtgatccaaagtactgatcaagcttgaaccaaacaacaagcagtcaagtagaactcgcaagttctcaaacaacaactcctggtaaaagattcttaagcttccatttgttattctttctcttttccttcttgcaggatcaaaggagaaaaatagagccaagccaaaatcaaaatcatgagcgaatcaaggtcaaaatcagtctaacataaagcaaaaataagctcgaattgagataaaacttaagtccaagctgcggcaaagaataggaaggagtcaaatataactcagaagctctcaagtagaacttataactttcatggtaataaactctcaagccccatctactattctatttttttttacaggacaacaggttcttgaatacatgaggcaaaataaaaataaacaaagtcataatgaatgtcaagcccaaagataaggtgaagactaagttaaggtaaagacagcttgatatctgacctcatcaaaaggccgatctcaattgaagtcagatatctgatctcatcaaaatgccgacctcaactaaaggcagagtaaatctgagctcatcaaaaagccgacctcattagaatgatgaaggctgagctcatgaaaaagctggcctcaacagaaagattaatagtggctcatcagaaagtctagcttatgaaaaagccgacctcaacagaaaggcttaacagatatttatcagaaagtgagacacccaatctccagattagatctcctcaaaattcaatattcggattggtagagcctcgagaggtacaaatggagataagatctcctcaaaattcaaactctagattggtagagctccgagaggcataaatggagataagatctcctcaaaatctaatctccgaattggtagagtctcgaagggccaaaatgataataagatctcctcaaatccaatcttcggattggtggagtcccgaaaagcacaagtagagataagatctcccaaatatcgatctacagatcgagattatcttcagttctataaaagtctaatctaaaggtcaagattattttggatttctatcaaataccgacttcaagtcaaagttatatcaaaattctataaaataccaacttgagggtcgaagttatctttcagttctataaaataaagacctaaaggtcgagattatcttaaatttttatcaaataccgatctcaaatcgaagttaacttgaaattctataaaataccgatctgagggtcgaggttatctttaagttctgtaaaataaaaacttgaaagtcaaagttatcattcagttctatcaagtaccgatctgaggatcaaggttatctttcagttctataaaatattgatatgaagtcgagattattttttagttctataaaatactgacctgaaggtcgaagttatcttttagttctgtaaaataccgacttgaaggtcgagattatctttcagttctatcaaataccgatctgaaggtcgagattatatttcagttctataaaatatcgatctaaagatctagattatctttcatttctatgaaataccgatctgaaggtcgatgttaacatacagttctatgaaatactaatctgaagatcaaggttatctttcatttctataaaatatcgatctgaaggtcgatgttatattttaattctataaaatactgatctaaagatcgaggttatcattcagttctttcaaatactgatatgagggtcgaggttctcttttaattctataaaatatcgatctgaaggtttagattatcatttaattctataaaatactaatatgagggtcaagattatctttcagttctataaaatattaatatgaatgtcgaggttatcatttagttctatcaaatactaacctgaaggttgtgattgtcttttagttctataaaatatcaatctgaagatcaagattatatttcagttctatcaaatacagaatctgaaaatcgatgttatcattcagttctatcaaataccgatccgaaagttgaggttatcttttatttctataaaataccgatctgaagatcgaggttatattttagttctataaaatatcgatctgaaggtggagattgtcattcagttctatcaaatatggatttgagggtcgaggttatatttcaattttataaaataccaacttaaagatcgaggttatctttcaattctataaaatatcaacttgaaggtcgagattatctttcagttctgtaaaatatcgatctgaaggttgagattatcattcagttctatcaaataccgatatgagtattgaggttatctttcaattctataaaatatcgatctgaaggtcgaggttatttttcagttctataaaataccgatttgaagatcgagattatctttcaattctatcaaatactgaccttaagatggaggttatcttgaaaatatcaacctgagggtcaaagttatatttcagctcatataaatactgacctcatagtcgagattatctttcagcttatataaataccgacctcatggtcgaggttatcttgaaaattactgacctatggatcaaggttatcttggatttctatcagatttcagcctcaaggtcaaggttatatttcaactcatataaataccgactttatgattgaagatatctttttagctctacaaaatatcaatctcaaggttgaggttttactgacctcaagattaaggttatcctgcaaaatacagatctatccatacttgaaattctgaaaatctttgaaggtattatcaatgaaaaatgctccaatgagtttactcttacacattatcttctaatctatgaaaattcaatctccagattgatagagccccaaagggcacaaatggagataagatctctcaaaatccaatctccagattggtagagctccgaaagacacaaacaaagatcagatctctcaaatatcaatctatggatcgatattatctttcagctcgtatagatactagtcgaccttagggtcgaagttattttattattctatcaaatgtagatctccagattaaagttatcttaaaattctattattgatctccagatcgaagttatcttgaaattctattatcgatcttcgaattgaagttatcttgaagttctattaaatatcgatcttcggatcgaggatatcttccaatctactcaagattacgagcaattcacttaaaaaatcaaatggtccaaattcgccacctcgaacaaactgaaaatttatttcttgggctacttcttttgtccaaaataattttttgagatcagaagtggggggcaagtgttatgggggttatctcatctcagctcataagaaagccgacgtgaatcaaaggccaagtttacataaagtcgatctgaattagaggctgagttcatataaagtcgatctgaaccagagattgagttcatataaagtcgatctgaattagagactgagttcatataaagccgatctgaaccagaggctgagttcatataaagccgacctgaattggaggctgagttcataagaaagccgatctgaattgaaggctgagttcataagaaaattgacctgaattggaggctgagttcatataaaatcgacctgaattagaagctgaatgccaatctaaattggaggctaaatgctgatttggcttaacccagctcatctaaacaccgatctaagctacctaaattgatttttggtgaagtattataatcagcttatatatataccaacctgactcatctcagctcatatatatactgacctgattcatctcagctcatataaataccgatctgactcatttcagctcatataaataccgacttgaagtagagtattacatatatccaagatgttcagggtcccatatgatacttgatttcattttggtattttatcgaggtgaactattatattgatgatcacagtcatcctgttaaagtccgtcatgatctctacaactaaactacaactgaccacgatctcatatacaattgtgctacaatttatccccaactggcacatatatctaagtatgacctcatttctagctaatatatacagctatgctgtagctcacttacagtttgctttcaacggcttaacaaactctacagctggcttctaacggcttaacaaattcttccaatggcctcatcagtccttttataaatagagggccaaagaattttccagataagttctgactcttatgtcccaagctcaaactagagggatactctatcactgagaatctagctcccacaaagtcacaaactctctaatttcatataaatccttcttctctctgttttactttttcatcttctattctcaaggctcaaactgacttaagcatcagagggtcaaaaatcggaggatccatatatactgatttttattttgttttgcaggattcttcgaaggagactcggattggatcatctcagcctctcctgcatgacttcatccaatctctccgtctgagattttgagcctcatagcaacaataataatataatataatataatataatataatataatataatatatatatatatatatatatatatatatatatatatatatatatatatatatatatatatatatatatatatatatatatatatatatatatatatatatatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtaaagcttgttaccatattacaattatttttctctttgcaaagcttgtgagaatgagagaaaaggttgccatatttctattattattttctctttgtaaagcttgtgagagagagagggttaccatgcatgcatatttcaattattatgagagagagagaagcttaccatatttcaattatttttctctttgtaaagctaatgagagagaaagagggttaccatatttccattatttttctctttgtaaagcttatgagagagagagagaaagggttaccaaatttcgattatttgtaaagcaaatgagagagagaaggtgtcacatgaagcagggtcatcttggccgccagaatggtcccggccacgagatccacttgcttggccccatcagtctccttccaccacatgcttggggggaaaataaaaaatcaaaaactatccttttagcagacgacgaggtggtttagctcttcatgggaataataacaaattgtttctaaccagagggaaaaataaaataaaaataatttttattcgtaatagtatatatgctttttagaaaaaaaaaatctttagatcagtacaaaaattgaacccccccccaccccacacacacaaacaaacatatataatacataaatatgaaatcaaacacaatcgatatcatataaacataaaaaaattcaaagttaaaaatataaaaattataataattacataaatattatatatcataatataatataaacgtgaaatacttcttcaagaataactttggaagcttggttgagtttaccaaacagctctaaaagctccatcagttaataagttggatcgcaaagtttaggatcaaatcattcataatatatcaaagcaaccagaaatcctactggttcggtccaattgctgttatgcatattggattgccatgttaaaaatacccttgtattctgcttaatataaacttatctcacaatcatttttcagtaaattaacaatgataatatgtaggggtaatcagaagaaatgaaagatgtgtcggtactctggtgtcatgcatatagaaatttttttatttattcatttaatatttttttatctatttttattcaaaaaaaatatttttatttgtttattattctatttttctctgctccatggtccccaactaggattagggtttgtgctcttggagccttctatttaataaacttatcttgccaggagtcataaataaggtcggtttgactctctcaacatattcgtcagtaatctgataccgaggctgacaattgtatgagaactggtgttataacatggacagatgctgaagtggattactaactctccctctgggctgccttttcctcgttggaacggaaacagtgttgggatttttggggaggtcatctcaactcttaaccaaggagacaggtatggggtcccccagggggggcccaaaaaaatcttcagagaattcggtggtggttactggtgacctcgttctcaaatcccttgtctatcattgccatcgtccttattaccaacttggctgacactgatatggtgcattcgcccaagtcaccgaagtcactacattggtttcttctaagcaggtagatgcatccctagttgccttaattttctgcaatgagttgctttatgaagtcaatgcatgacatcaacagttgattattgagaagaacaccaacgcaatcataggaacataacacaaattctctacattctctctctctctctctacaaaaaaaaaaaaaaagcaatttcactaagttcaaagacgtacagaattaccaaaaattttgcgaccatttagttcttctttcagtataatttctggactgcatttggtaatataatattaatataaatgttgatatatgtgtagatattttcatcttatctcaaactttctggactatatatgaaacaaacttgaacctaaacatggtgcctcttgcaagttgatgaaagccaaattgactagcattattggtgataaaagcatgaactcttacaccatgcactcgatcctgattaccagttctaaaagtagtggccaagtctagtcaattgctagcctgtaaggttgttagttttaggaccacccagtgtatgccaaccgacatgccacgaccaatgggctaatcttaaggatttgatgtgataccaaaaatgtcacgccaccactcccctctaatttaacatctttaatggttcaactatggcataagcggctagtttttttaatatacaatattaacattactttcttagtgtatgcatgcaaggataagtatttattgccgatggcttacgtacgttatcttgatgccacaaactgtagcgaatgatgttggttgtctttctttttttcttttttttttttttcatttttaatcatgtagatccggtaaccaacttaatttatatccttagctagtaacatttaccaaagtagtgtatcgatacagctagtttaaacaaaaattagacctgaattaattggattcaaccatggtgatccctccccctcacatgcatcgcagcatattaggcagcattttttttggcatccaagcaagttagctatgtgtgcaaattaataagcttagaacaaggcaatgattcctctacagcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaaataaatttcttcctatataaatcagagttttcattgattcacaactaatgtaattaagattaacgatgcccttcttctacaccataatatagtcttctcctaatttttatcataattagtatacgaactggagagagttccatggttatagaaatgattctttatttggagtgtcactattgcgatcaagagctcacaattcgacatatcagatattgtctattttgactcatgaattttatgatttattttttaaaaatattttatttgaaaaagatgattctttttttatataaatcaaaaaaaaattaactcataattaatataaaattaataatatattttttttatatcactaacaaaaatattttgagatctgtgcagtgtgagatggccaacgctgtggaacaagcttagttgtcctttggggcaaaagattcagcccgaacctataagagagaagggtttacttagaaggtcatctttgacaggacccacagaaaggagtcacggggttcacttgattccacagttatcgtaccctagtctacagtagaaatcgggattcatctcacttccccatccgaagttccaactaaactctgacaggtgtcaatcccttgagcatcatgcaaggcattccgaaacaaggcatcctacatgggatcgagattccatgtggaaagaacatgcatgaatgcatgcatgtatgggagttggtcttttgggaagtggtggctggcgagggagggaaagactacagtgaattgaaaaaaagagaatttattaggggtcaacagagtaacaagagtcgtctgaatagagtaccatgctccattttcaaaagaaaagagaggacataaataaaaaaaaaaaaaaaaattaactggccgaaaatatgccaagaaggagagaggatgggtggaaaccaaagtggatgagaggaccaatcgccacttaagaggctaccgccaacatgtcctcccattatgaggtctctttctcatctttaactcctcctccatgcacccctcccttcatgtaggccctccccaagctatgagagccttatttaacccctcctttccattcttctccactccatggtgttgtgtagagaggtagattaatgaggataagagagagcaatcatagtggtactggtagcgctcaagtagtaatcacaattaatactcgtatcgatcttggtattgtgcaagtttaacaacttcttccatcttccccaccacttgcaccccttcaacaggaagaaccacttattggacagaagtatttatagggtaggagagagggtgaagggggtgatgattccatagctcaccagtttatggcaattatagcagccatgagtgcaaacgacggcaaggatgatcacgagcacgaccttgtcatgcccggctttcgcttccaccctactgaggaggagcttatcgagttctacctcaggcgcaaggttgagggcaaacgcttcaacgtcgagctcataaccttcctcgatctctatcgctacgacccgtgggagcttcctggtttgccactccacttcctttttcccttagaaccatctcttctctcttcccttcaactcttttgtctttttatttttgcttttttgttcatctttgatgcgtagtagacacaacttttttgagaattggtcgtatcgtatatgtgaaacctttagtttattaattgatcttctctttgctttcttgtgaacgatatggaattttgatgacagcattggctgcaattggggagaaggaatggttcttttatgtccctagagatcgaaagtatagaaatggtgatcggcccaatcgggtgacgacatcgggctactggaaggctaccggagctgacaggatgatcagagctgagaatcaccggtcaattggattgaagaagacgcttgtcttctactctgggaaagctcctaaaggcatacgatcaagctggatcatgaacgaataccgtttgccacagaacgagacaaatcgatatcagaaggtaaactggagaaagttaggtattcaaattattcatcagttccaagtcttgtaaggtaggaggtaggggtgaggagaattgaaggaaacttctaattttctggttatttagagcactggcgaggcatgagtcagtagataatcaaaaatttctcttctttcatttctgacccaaaaaaagggagttcttcatcctatttttccttctatataatcttccatcaaactcaaatatatgcagcattctagttgtagtcccaaaaattatgttgaggtcggacatgaaccgctgacggcaagttagggtttccacatattttttctccaagtttattttcttgtagtttttttttttttgacaaaaatcttttggttttgtgaatgtaagtttaatttcctcctggccttgctactcaattaacatggacctgttgctcaagttgtcgccacatacttttctgaaacaatagttagataaaataaaaagtctctcttcggtcttgtttctattttatctacatgattctctttccactttgtgatcctttttttcttgagctagcttttcatatctgatgttttctcttaagtcaacaagaaggattagacttaacaataacaaacaaaaaagggaggaggagaagaacaaggccttgtcaaatttctcctccttcgtagtaagtttcttctttgtcttctccaagtcagaaggtttgccccataaaatctgcttttctgcaaagtatgcattttgttttggatttttctgttgctctttgtgaaccaagcttactgttttaaatttcttcttcttcatcatgtcgtctctttctcctcctcctccttctccttggtctgcatgtcctgttcctcctcttattcccttcttcttctctccttctcttcctcctctacttcttctacttctccttctccttctccccctcttcttattctcttcctcctcttcgtccttttcttcttctagtgctgctgctgctatagcttccttgagctcttcttcctcctcctcctcctcctccttctactttcacacctgcagtttggttttatgcgttaacattggtttagtaacaaagcctcatgctccctcgtcttctttctacttttctttcttgttgtgcagttctgattgggatttttcctttgcagaccgaaatctcgctctgccgagtctataaaagagctggggtcgatgaccactgtccccagggcttgctcccttccaaggcatcctcatctagagggactggaccagataagagacacagttcctcccatcagccaccaccaagcttccaaacgtttgcaggaaacatctcgtcgccaatgatggagaaggcacacaaaatgggaggtggaagcaacgcccacatgtcggcaccgccgccccacaaacctactctctatggatcgacggcttcggtggcttcattgagctcgactacgtccactgaagaagatggtacaacaattcatccgaagaatatgaacgctttaatcccaacatgttccctcctcacttctgctacttcctccatggccagtcctacgatggacgagctcatgaataggttagtaggttgcaaccaaaactacacgaaccaacaacccaaccaattcctcccattgccaccgcaaccccagttgcttcctctcaacactctgcccgtttcatttccaaccatttcagacaagctctgggagtggaatcccctccatgaggttgctagggattacaccagttttaagtgatcgatggcgtgctcatacacttatatatatatatatatatgctcgctgatccattgtcctcctcatatttttcttttcttttcttttccaacaaagactgctgaagtatgtaactgtgggtgaaaacttattctagatcaggtttgtagttcgactaagtttctataagtttgcatggctattgttatcatgtgtcgagttttattcttcttggatatatactccaaatctatgttataattttgggaggatggtaaggaagaaggaactttcttttgagattattattccatcatttgacttctgaacataaaataatgatgccgtggtttgttgaagacttgcagagagagctgtctgcagggagtttggatatgaatgcgagtaccattacgggcatgtgattgcggcattgtcttttctttgggtggtaggactaatcaaactcaagtgagcattctgttaagtctgtctgtagctgaagtcatggaggatgatagattttttagataggattgaggggtggatcctatcactgaaattttaaacttctcttattcatatatacgttctcatcaatgaatttagggcattttatcatcttctagggtctcttttggtttggcatgtatttcctaaactggaaatatttcagatcagtagttgtgagaggagattcttagtctatatgtggtatggtcttgcactccctttcacttcctcgccaatagattaaaatgtctgagatgtgggcattttatcatcttccaggggttaaaatttcttgtctttgcatgcgtattctaatctggaagatatttaatttagagacatcacattttatcgtcttccgtgatgttttactgtttggcatctacttgtggcggtcaggtagtatctcagattggaagtcacgagaggaggttacggcctagctatgtatagatctggcgttgcttctcactttgttcactttctcaccaatgatttaaactgtctgatatatggaccctttttgtcatctcaagagcttaaactttctccatctttcatatctcttctaatctggaagacattttaggttagtacttaagaaaggagctcaaataggctatgttgttgagctatcttattttgaagctactcttgcactcatttcacttgttctcaccttaaaatgacttgggataatagcacttgaccatcttctgaagtcctttcttaacttggatatcgttttcttctttgggcagtgttttagatttcttttgaaagctatagccttgacattttatttcactttacatgttctcaccaataagagtttaactagtatgtctctgatagaagtattaattaatatataatcttctagaactttcacttcttttggttccagatgtcttgctgagcttgggcaatctcttaggttagtagccatgataggggttggaaactagatacatctgagctggcatcatgttcttgcgcatgcctaagaagtgtacaaattaacaatgtgatctggtccaagttttcagtccaagaatgcatgagctgtctgtgtgccctaaaggtaacacttggatgtggagattttgtaagcacctcaaccaactccacttctagccttaggccccctatatatattttatcatacaacttgttatgtgtcttaatccaaaataagccatgacacaaatgtgtgcattatcggtaatgactttcaaagattgcgacgatcgataaatctgttctagaccatgttcactcactcttactgtgaaatcttttcctcagctcatggttttgattttgaggtatttccaagtttccataccagaagtatagaagtcaaatgcaacactagagtttcatggcttctttaaatcttttagccaagaacaaattagctaaagtattagttagatcctctcattaaaatatatcgacgaagaatggctttcggagaaagctgatctacttcacatgaactttcatttatgatcatctgatccaggtccaacagtgaaaagaataaattattttctaaaaaaattaagctaggacaacagaaagagtatatatgactgtaaaactctcaattagtgagattacttcatatatataagattgttataatgtgttcactcatggtgagtttggttatactttttgatttctaatttttgatttttaaaaaaatatttttatttttttatttttattattgagtaaaaataaaaaatatgtttagtaactacgttgctataaagcaaaaagcaacatttacggatggcagatgaagaacttgacaaaggagaaaagttcgaaaagagagagagaaaggagtggagaggtgaagagctcgacgagggagaagggttcacgctctttactttttgatttgacattttatatatgagaaagtaaaaaaaaaaaaaatagaaaagcaagttttggaaaacaaaaaatttttactttgtatataaaataattattttgatttttttattttgattttttatgatgttattaattttttttatttttattttttaaaattaaaaaaaaaaattaatggctaaacaaatgcacactcagttgctatccttaattgtccgagtattccgaccagaaaataatctagagaatggatggtttggtttctaatcctgccaccttttgttgcgagtccatctttattagctccatgaatcatgcactatcatcatgtcaatatttattattgtagataattaatgacttgttacaaaaaaataggagattttcacctaagtttgaaaaagatgaaaagagtatcagaaccaagaaaaaaatgaacgagtctctgaatttttagaatattttagaagaaggcaattttaatcagaaataaaaaaaaatcaaaaatttgcatgattatgaagcaactatttttcaaaacaactatttttgaagtaatagaaacaaaaaataacggttgaaatcagagattcagggccgagaggctgcttcacttcttcacctgttcaaaacaatacaggatattttcaactcacacatctaattgagcatattaaaatattagaatttttatggagattgcaggcatgtatggttcggggaagttagacaccagaaggcgaatagaaatgaatctcctattctaactgtttaattaagagactccatctctattctgatttccatagaaaatggtaatatcccaatctctcaaaactgaatttttattttttttttaaatttaaatttcattctgattctgcttataagtcagaagatatgaccgttctgattccaattctcgttgcaaaccaaactagctcagtgcaaaccaaacgcaccctgatagtttgttgccttggtactggaggtccagaaggcaatatatttaggattatcagatagacctttttaggcaacattgagctagacatccagagccatgagaactcacaggacggaaccaatccctcatctaaatcgccgcatgttcaatatgtgcaagttcagcctgctgaaaaattatatatgaaaatttaagcataataaaacaataaataccaaagaccatgaagggggataaaaggaaaaggtgtttagttacaattcatgcaaaagaatggatgcaggcgacaagtcaacaacagttgtgaacagcctttacgaaaactaggagtatttcatgattaggctgtgaattattcctgaatcattacaaattaataaattagtggatacatagcaacatattcatttgattgatgcacccaaaccacaacctccaaatgtggtttgatgctaaatgagcaggcaggttagccgttctaagaaaagagagtgaactatcttgtttaaaagagctgaatgtaaggaacctgcagtagattttggagctagacctgcaaccagatctactccaagtccaaataaggttggacagatcctggcccaagctcaacccgactgtttccaggtttgcacccaatttatttgattgatgacagagagagagagagacagggagagttttgtgggatatatcggttttatttggtaaatgctacctcattcaagagatgtaattggtcgatgatgtatataattataacatcaacaacagctgttgccatgccatacacatgtgagattaatgtgccatgccatacacctgtgagattaacagtggatagactcactagttacatttgtttggccaaggcccttgtcaggcactagtaactgctatatcctgcaacaaatgtcattccaaaacaagaattttccagctttcgcattctctgccacaagaaaaaattggtcttggttaaaaaaaaaaaatgcaattcatgtatggcaagtgacccccaatactttgcagcagtgcctgtttctttaaggcgcctcaataaatcaccagaagacctcaactcttgaatgctaatcaaccagtaacacttcatccaatcctctttttatctccaaaccacgtactttctgtctcattcaattgaaatcagcagcagctattacttggctcatgctcattatgtatcaatgatgttcatcaagagggttgaggaagaactttaagattcagcaaaaagaaaatgaccataaagaccataatgctcacagaaagaaagaatacttgatgttaatgaggatcgcatatataagcatgggtaatcacataaaatgttacatgatcttcaatgagaagtgctgactctgccagggtcgttaacaataaagtggaataaaacctaactcgcaactgaatgaatgatctaaaaacaatttaaattacctcatactgacaactttcttacgatcagcttcaagtgcttgcaccatgcactttgtgaaaaatcaaattttgggttccccagccatgtgttacaaggaaagtgaattttgaagagagggaaataaactaatatgatgattcaagacacacacaaaaaagaagaagaagaagaagaagaaaaagaacaagaacaagaagaaaaaggagaaaaacttgcactttgacaattaattgctccccataataaaatccaatctcattgtgctctagtccaattcagtagaaaagccataaagtgattgacagaaagaatgctgaagtaacaaataataagatttagaacaaactctgaatctctcatcatgtaaaaggaaactgatattcacaaacgatccacaagaccaaaaaatgaaccacttaattcataaggaaagcaagagtactctgtaaaaataatatatcattctatgacaaacatcttgaacttagcaaggtgcagtacatatacaatatgctccataaaattacaaaattaaatcctgtatgacaacaggcaaaacacagagagcctgaaatttgctgtttacaactcacattactaaatcactgtaacagctctcttttaagaacctaattgaaagagaacatttggagaggcaagttctccacatattttaattgaaataggttaaaattattggggaggcatgtattcagaacacaaaccaagtccgtagctgagagggaacagttgctagctctagatttgcaacaactcttatttaaggcaagcaaaaaccaagtaacatgttcttagggaaaaagtttccctcttccagatagtcccatttgggtccataccaaccatgtaactaggctatggaagggtagaccttgctctatacaaaagaaaatcggaaagacatacaaaaaggcagcatccctcaacatatttaagggttcaagcagaatgatagcaacagcaacccctgctatgagaactaaaaccaaggaaacaacctgccctcatgaggatgagttcagggtgtctgctagaggaaagaataaaaaaaaatccatctagaagtgcaaagatgtctatatgcaagaggaaatacagcaaccaaaaaatgtctgtcatacaatagaacatcatagtcaggttcccaagatggatggatgtgagaacgacattgccctgaactgaaaaggtatgaaagctaatgataaattatacacaagcttttgcttttcagtatcatgatgatgctttctccagataacaccatcatctctagcacacgaaggcattattcttgagcaagatgccacataggaagataatgccaaattctcaacatcaggagattcgtgtgcaccattcgacgagtttgataaactcagatggaagtccaaaaaaaaaaattcttagtggatgaaacaaaaatctgattaatgacacaaagtttatgcccaaggtgagagaggtcatttgtggacatgctaacaggaatctcggcccacaggaagcgaaggaccagatcccaaatttaatatcaaactcaacagaggtatcaaacaattatataaatatacattaaagtgctcagctaaaggcaattcataacttgtagagtcccacaagatgtcgtacaacagagattttttggtaagaaatgcaaatatctaatggttattgtgtggggcaaaaacatcaattgtgattctataatgtaatatcgctattgctaccaccaaaaacagaaatatcgacaataaaatgtcatacactgcaccttatgttggggatattcagtcaaccatgcatcattgttagatactagcctatttagccaagctacgagaccagatattaagcatgaagaacccacaccctcataccatcaatccattaaacaatctgataatttagctcaatctgctcatagttgaacaaaatagcatcccatgaccatcatagctttttccatactattaggcttaacctacagtagctaatatgccatgaccagtgttttgtcttaaaaacatttcatacatgactgcataaaaaagcttttaactgaaattccaaatgcaacaaagtgaataagaagaaaaaatgtgggaggaaaactaacataataggctgtataagctttaaagagaccctaagaaatattggtgaacatatatttagaaagatctttatgcatgataaagttaaacagatgctttggacttataatcataagtggttcatacattggctacacaaccatagccatttaggacacaagtactcatacacctcccaaactacattcagtgccaaattatgctatggtttgccataatggaacatgccatccagtgcacagcaaactgcaccattctaaagcgaacagatccttggaatgggtggcatatcgactaccaatcagtaccaaaaaccaactcgcattgacactgtgctaccatgatatggtgtgggtaccaaaacctgtcattcgaaccataacaccaacttattaggactccaaagctagagctcctctaagcattcctgggtgtggcatttgtcatgcagtggcatggaaaggaatgtccatcacatcagaaaaacttaaaattcaaggaaatgtagtatattggtcaaagtatcagaaaactttgggaaaagttggaaaataaaatagaacgagagaaaagatgcaagtacctatatatactgatatgtaagtgcacaaacatcagagagcatgagaggcacacacaaacacataacatccaataatacaatatatacattacatgaatgtccacattactgaagaaattactgagacagttttgaggctgaatccatctactatttaccaataaggacaaaaattctaaaaaagtaaaaggccaacctaatagttgcttcttgatcatagaaaacccaagagaacttcttccaaaattcaattcctacttgtcacagttccacagatgagtagataatccttagaatcataaaatactaagcatcatggtacattgcctgttcatcattacatattgcatatagaaatcaaccatactctaggaactccacattgtaaggcatccttaccgtgttagaatgagattttctcagaacaaaaatgatttctatcatagaaaaatcgtaccaaacttttttgtcaggttggtttgcattcaagaaaacaggttatgtttcataactgatagattcaaaacaacacaaaaaaagaaaaaaaaattctgccaatgaggataccatgacaaatcaatcaaactgtttgctaatgttctaaaaattgctttttaaaagatagatggtgaaaaacagcaactctttctgtgatcatatgtctattattgtatttctaagctcataatgtttactgaaacccctaggtttcttcccagaatgaaaacagaacagaaacaaataaatgtgaaaaaagaaaccctgccaactttgtctttttctatatggatcaataaggagtttcacaatcacaaatccaaaatgtgtggctataaagctcctgttgcatgcttggcatacatctcctgtgaactcacactttctcgagtactggaagtgaaactaacagcaagaagagtaaaaacttgaatttaaccgaagatgccaacactcttgggccctaggccttatttccatgtatgagatcagttccctgcagaaatttgtaaccagaccaattacagacatatcagggacatcaaaagccaagcatttatgatgaacagaatctaaaccaacctttaggcttaagcagttttctcaataactcaaacaaaaattcagtgacatcaatgtcaccagataaagatctgaaaaatatgcagaaaaggaaaattttagacaaaatattaaaaaataagttgacaaatcaataatggaagacataaaaaagtacctatttaggagcaccattcacgagcattctgaaacatccttaaccatggacttgggcctttcttgtcaacttcccattcctttggataccacgggaactgccatatcatgaagcaacgctctggatgtggcatcatagcaaggtgcctcccatcaggagaacaaagagctgcaactcccagaggcgaaccatttggattgaaaggatagacctctgttatgctgccagcatcattgcaataccgtagaggagctagattagacttaagaacacattctaggacgccattatcagggaaatatgctctcccctcaccatgagctgcccaaacacccaatgtagtgccctccattcctttgaacatgatggctggagagtccccaattctgacacttgtaaagcgacactcaaaacgaccagattcattatggataaaccttggttgtgacacatctccccccacaccaagggaacccccaatatcagccccaggtacccatccaaggagagccatgagctgacatccattacatactccaaggctgaatgtgtctggctgattgtagaactcttgaaattgccgtagaagaggctggttgaaccttatggatgctgaccatccttttgcagaatcgagaacatcagcataactgaaaccaccaacaaatgcgatcccacgaaactcatttaaagagattttccctctcagaaggtcagacattgtaatgtcccagggttcaaatcctgcagcatagaatgctgccgacatttccctatccccgttactcccttcctcacgaatgatagctaccttgggctttaaagttacagccattaccttctcatctgtgaacttgggagaaaaagacagtgtccatgaaggtgcttgtctgctttttaagccttctttctcaagtctcacacaggaagccaacctttggaacccctcgagctgaaagctagtctcctcccataagtccctaaggtaagatgtgtcctccttcagctgaagtattccatcaacagacaactcaatcactggtgatgcagtaactttaccaataacctcaccagaaatgcctgctgcttcaagcttttgcctgactgtatcactgttctgcgagctaacctcgataataagaccaagctcttctgcaaagagtatctggagaatattattaccctgggaattcaagttcaactgcacaccacaatttccagcaaaagccatttcaagaacacaaactataagcccgccatcactgatgtcatgaccagcagatattaatctttcactaagaagctcctgaatagtctcaaaaaccttcttcaggtaacgtacatcatcaaggtcagggcactcatcaccaatttggtcaaaagcctgggcaagagaagatccacctaaacgacgcttccctttagctagatcaatgtgcatcagaacaccaaaattttcaagcttcaaatctggagtcactgtcaatgttatatcaggacaggtaacataggcactgataaccaaacttccaggagccttgacaacctcaccacccacatgagctgccatagaaagactgtcctttcccccatctattgctatacccaattcaatcatagactcagagagtgcaactgcagcatcatacattgctgctccttccccatcaagctttgcagcatacatccagttaccactagctttgacatcactgagagatgtaactttggcccagactagattggtcaaggcctccccaacagccaaccttgccatagatttggggttcagcaaaccctttattggctgctccccaatggcacaagcaccaccagtcaagtctgtgtatgtctgtgcaataacagaaacatcagaaagtggaagttggagaggccccactgtttgctgctgtgccacaagacccgttacacacctgtcaacttttgttgttaagaagcgtttggagcaaactgaaggaagtgccaagactctctttaaagtctccattaatggggtgccaagggcaatatcaagtggctcttgcaccaaaggcatccgcttgaattcaaagcacttctgaggcatgtctccaagtactttttcaagctcaagatcctctacaggaggggggagagggagtccatttgactgacaatgctcgatagctgagctgtcaattaaaacaatacggccactgccactgatggtaccaatgactgccatagacactctttccctttcacagatggattctagtaagcttcgtttttcaggtttcactaacaatgcatcctgttcctggtactcagcaccccatatctctaaaactgacatggtctgatcacctactacgatagatcgaatatcaatttcagctccttgaggatcaattatttccttcacaacattacaatttcccccagctccctgatcatgaatactgatgatagggttgttttcccccatttcagtgcaagatcggatcacacgatacagcttctgtgccatctcagcatctcctcgttgtacggcattgaaatctagttctgcatcattctgcccactgaccatgcttgaagctgcaccacctcccataccaatccggtatgctggacctccaatcttcacaactagcatcccaacttctggctctcgttttgatatgtgagcatgatcaatctgtccaatccctccactaaacataattggcttcagccattcacgccgctctccatttgggagcctcattccaaaagtcctcgtgaagccctgaatcaaaggctctccaaacttgttcccatagtcagatgcaccatcacttgcatctattaatatctgtagaggaggagctaagtttgatggatatgagaaagttggatcttcccagggagcatatgagccttccatgtgaaggttaccaacacagtacccagctgtagaagctacaacaaaggaaccccttccagttgcatgtgtgtccctgatgcgacctccagcacctgtctccgccccaggataaggagccacagcacaagggaaattatgcgtctctgctgtgaacaagatatcaagctcacgcattaacaaggacaatggagatgtcgagccaggtgctaatggccgcaactgatttactgggaatcccttgattgcacttgagttgtccttgaagccaatgacagaattgttgggatttgccttcaaagtgcttttcacaatctgcatcaatgtcctgttcatcggtttgccatctataacaagtttcccattgaaaaaccagtgcctgctatgttcactattggactgtgcaatgtcaaagagttcaacatttgtcgggttgcgtttaaaatcatccctaaaaagtctggtgtaatactgaagatcctgttcatcaaatgcaagacccattttcaaatttatttcttccaatgcctctcttcccttctcaatgacaggaaccacactaatagcctctggaactgcattagtccgaaaagatgtgagcttctggggataaacacactctgtcattctatcctgaaccatagctgcaaaatcattaatttggctctcatctaatgggctgctgccagccttgagatacagaagatatcttcttgacctctccatgcgtgttacttctgtcaaggagcaagcttggcaaattgatacagcatttgctgaccatgctgtagtaaaggacatgcggggaccaacctcaactaaaacagcaacttcacctttgcagacctcctcctccagaaagctctctgtctttaaattctcaggttcataggtctcctgcagaagccacttaagtattgtgagcttgtcacctgataagacaccactcaatccaatgttgaagcactgctcggtccttaaatcaacgatctgaccagaaatctttgcctggaccttcctgaggagctctgcagcagcactgtcttgaatcagggggtgacggtagaagtgtatgatctcaggggactgttccaatgcatcagactcttcggccacttgactctgcaagcctctagaaaccactgctttcggtttcaacaagaatggggaacttgatgttatacttcttctaatatttaacacaggatgacttttgtggccaaagctgccgtgaatcacacgacacctccttggacaagaatttgtacgcagaagaagattaggcctccttgatccctggaatagataaagaagagattccagaacaattaacatagtacagcacacaagaacataatgcaagaacaggcattgtgggtgcctaccccataaatcaagaaaccgtgctgccgcaggaattcagtagcagcagtctctccaagtgcagccattagatcactgcaacaactaaaacatacatatatacaaccgtgattaattgctcatataacaaaaagatcaaatttttaattcaatttaaagatacccaaaccacatcaaatcacctcacaaatatatatatatatatatatatatatatataaatacgaaccaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttgcaatcgatttatcgatcaaaaaattaaataaattggttgctaagttttttaaaatattttttatttaaataattgataacaaaatcaatcataatttattttttataatattttaatttacaaaattggttgtaaaattaatcactaaatttattaaaaattattaaaatcaaattgatttgaaaatcagtctcaaaatcgatcgttaatttttaaaaatatttttattttaaaaaatcaatcataatatcgattgtaaattattttataatattttttaatattgattataaaattggttactaaatttgttaaaaattattaaaataaaattgatatcaaaattgattgttaattatttttaaatatttttattttaaaaaaattaatcataatatcagttgtaaattattttataatatcttttttaatattgattgtaaaatcgatcactaaatttttttaaattattaaactagaatcgatctcaaagtcgatcgctaatttctttaaaatattttttatttcaaaagttgatctcaaaatcaatcgtaaattttttataattttttatttttaacatcgatcacagaagtagttgctaaatttattaaaaattattaaataaaaatagatatgaaaatcgatctcaaaattgattgctaatatttttaaaatattcttgatttaataaattgattggaaaatctattgaaatttttttatattatttttattttttattttgatcacaaaattgatctcaaaatcaatcaaaaattattttaattaaaataatcgattgcaaaaatttaaatttaaaaaaataaattaaaattatattttttttgttacaaaaattataagctttattgaaatataacagaaccaagtaacatcatcatccttcatacacaaccaaataatatatcctaaacaacaaaataaaacagaaaaaaggccaaaatataaatcctctcgtgataaaaataaaacacaagatctacaatcacatagcctgaaaataccaaagataaataatatagatttaaaatagaaagcaataaaagaaaaagaggccatagtaatttatagagccattcccttcaatatccattaagtttagatcgtcatcagaaaaaataagaagacaactataagtatatagcaagaaaaatccatcggcacttatcaactttaacacatcatatgagaataagacaaagaggccatagcatacgtcgtaccgaatgtatcacttgtttaacatacttcatgccaaatgtatcataatcataagctgtctttatctttcttaaacaactcacccgatagactttccaaagtattacctgcagcaaaaataattgatactaacataatatatagagccaataagataataagagagagttatttttactttcaattataaagaactcctctactgtcagttaaaagcaaaattcatcaacatctatcagcttcaacacatcatatgggtacaaaaaaaagagaccatagcaatctgtgaaatcattcccttcaatatctattaaatttagatcatcatcaaagaacataagtaggcaactataagtatatagcaagaaaaattcatcgatacctcccaactttaacacatcatatgggaataagaaaacaaggctatagcaatctgtggagccatttccttcaatattaattaagtttggattatcatcaagaaaaataagaaggcacctataagaatatagcaagcgaagcctattgacatctatcagctttaagacatcatatggaaataagaaaaaaagaccatagcaatctgtaaagccattctcttcaatatccattaagtttagatcatcatcaaaaaaaataaatagacaaatataagtatatagcaaaaaaaatacatcagcactcatcaactttaacacatcatatggaaataaaaaaagaggccataataatctgtggagccattttcttcactattcattaagtttggatcatcattagagaaaataagaaggcagccataagattatagcaaataaaatctatcagtatccattagctttaacacatcatatgtgaacaaaaaaaaagggccatagcaatctatgaagccattctctttaatatccattaagtttagatcatcatcaaggaaaataagaaggcaaccataagtatatagcaagaaaaattcattgacacctatcagctttaacacatcatatgagaataaaaaaagagaccatagcatattttatgctaaatatattatttgtttagtatacttcgtgccaaatatatcataatcatgagctacctttatctttcttaaacaactcacctaacagactttccaaagtattatctgcagcaaaaatatttgatatcaacataatatatagagccagtgagataataggagagagttatttttgctttcgattataaagaactcctctgctgtcagctaaaaataaaattcgtcagcatccatcagctttaacacattatataggaataagaaaaagaggccatagcaatctgtaaagtcattcctctcaatatccattaaatttagatcactatcaaggaacataagtaggcaaccgcaagtatatagcaagaaaaatatatcgatacctatcagctttaatacatcatatgagaataagaaaaagaagccatagcaatctgtggatccattttctttaatattcattaagtttggatcatcatcaagaaaaataaaaagacaaccataagaatatagtaagtaaaatctattgacatccatcagctttggcatccattagctttaaggcatcatatagaaataaaaaaaagagactatagcaatttgtgaagccattctcttcaatatctattaagtttagatcatcattaggaaataaataggcaaccataagtatatagcaagaaaaatctattgacgccccattagctttaacacatcatatgagaataaaaaaaagagatcatagcaatatgtggagccattctctttaatatccattaagttttaatcatcatcagaaaaaataagtaggcaaccataacaatatagcaagcaaaatttatctgcacccatcagctttaacatattatgtgagaataagaaaaagaggttatggcatacctcatgccaaatgtatcacttgtgtaacatatctcatgccaaatatatcataatcacgaaccgcctttgtttttgttaggcagctcatccgatagatttttcaaagtattacctatagcaaaaataagtaatactgatataatatatagagctaatgaggtaataaaagtatcatttttacaatcgattataaagaatccctctgctatcagctaaaagcatgtcaaaaagctaaggtaataataatcagatattcacaaaatatgcattcatgtacaatcctcggcatagcatgaataaaacataaatctaaaaaaataggtagcaaaatctaatcactgttctcctcctcaatattatcatcatctctacctaggtttaaaggtgcatactatggtactggtgcctgataagtttgatatgaccgaaaaatgggtggctgcgaaggagatgattgaaaactaggagattcctgaaaactgtgagatggttgaaagtttatctttacaggaagctcacgcagtaacctattttttacatcaatctccttttcattatgttccaccctctttctaagtttatctctttcacgttcagcagcttccacccgagaattctattcagcttcaacttgccccttatttactcatgaatttcttgactttgcatctattctgagcatgatgaaacttagctatgaaaaatatgatgaatttgtcaatatagtagattctaatcctaggccataaatcctttctttcttctttccaccaactatgtgaactcacatatccaactctgatggcagaggctgttgagaatcagatactctctgagattatgcctccttcatattacgtcgaaattcatcctgtcaaatttgtctcaatttatataaagtaagtattaaaaataatatataatatattatttacactaatatgctctgatctcctatccatccaactcttatccttcttttgatgggtgtgcataaataattcagatagagaaggcacagcaccagtcttcactgtttgtaatattttaaaagatataaacatcaactcttatagaaactattataatttgtaactatgaaccaaatataattaataaaaaaaattagatttgaccacgttgtgcatatattgagaagtggtaatggagccaccagtgtgaagagaagcaccaaacccaccatactcagaagtacaattttgtttagctttttcatactttttttttatattgtacagtactccagtgttggcccaatctgtcccaaatagcatctccaatccaaagtggtctctccatattcttacgagtattaccaagtagatttttcaatcgagctgcaccatgcttttcaaaattttttcatacccattgatcattcggtggcacaaactgataccttctctgcaatatgaatatggacaaataaattaaataataaataaaaataaatagataataaattgatcacataaatatcattatttacgtaccttaagcttagtaaaccacatatctctaatagtgagagatatttttttttcatgatatcgaaggctcatcaaagtggctcctcataatttcaacaatggcatttgcgactgggtgagaagataagaacctataaatattataaattattagtcagtatagatcaaatatattcaacatgctaaagtgactatgatattctaaaataaagttatcacttactcatctccatcaaagtataacactggcatgccatcgctagtctgtgtctctgcaatattttgagaatagctagtttcaggatctataaaatgaatagaaggagatgttgaatggacagcaggtgattctgaatggataggaggtggtctaggatgaataagaggtgtcgcagaatgaataagaggtgctgcatgatggataggagatgctgaataaaaaggtggtgaatacatagcacctgatggtgaaccagcaggaggtggtgaataaacacttggcatcaaaaggggggttgtcgccagtggataggctgggaggaaggggtgctggtgtcgcatagagagggggggctgctgtcgccagggaggggagagggcgctattgcggtccgaggggggagggggcggcgtggtgcggtggttaggtcgggggggcgctgggtggtcgatagagagagaggggggctggctgtcatcggggaaggagggggcacgtgggtgtggtgggtagggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacctatccttcaacatacccttaatcagtgcattccttgtgctcctcttggtggttctgatgcatatccacttcaacatctccctgtccagtgctcatctgtttgggctatctttattttctaaagctctttttcatacttatttaatgctttccccactattacatccaacctgttctactttagttaattaaggtttcatcaacagtggatttgggcaaaacctgtcatctgccttgtaaactcaaggtcttaaattttagaactaagatagaggtggccaaacatgagagatataatactgtgaccctcctatactgctgttgttcaagcacttgaaaggtcaattgcttaacaagttggttcacttctccaaatattgattacaagagtaacgctttaagaatcagaagatgaaaaaagagctccttgcctgggagtcccagatgtccatgttgcatgtaccatatttttcttcggtacttcagacttgttaagatggtcttgtttcttcctttattttcctccatttcttttgttttttcccctctctgtttggtgctaaaatcatcactatattcagcaatctaggaatatctgtcatcagcttctttgagtgcaattaaatgtttacatcttgacatatacttataaggtgctatttatgatgaagcatctgcattgttgggcacacatgctgaactttgttaagatgcttagtattttctggtctgccattgcagcttctgcttgctcttggcactaaattggagcatgtcattactcagttggcacgtgaggttgctgaaaagcattcagcaatagaaggtgatctggtagtcaagccatcagatgatcacttctggttccaccggccgcgtcttgtactgtaccttgttcactttatcctctttcaaaatgccttcgagattgcatttttcttctggatactggtaagcagcatagaaaataaaataaatcttgcatctgctcttgatattaccagacggacaacctccaagcactttatgtttatacagttgcaatctttccttgaggatagaacaaaaactgtaaatatatttgttatccaagccaattgatttgtccgttctgttgctattgtcggatttatgatttagctgccagagatagtggacaatctaataacctgtttgcagtttagatgctaaataaactactaacaagattttcttttcccccttcatcagactacttttggcttagattcctgcatgttggatcatgttggttttgtcatccccagacttgtgattgggtagctagaaacctcgcaccctttttttttccttcaagaattctaatttcatggttcgtatgctgaaaattcatgggtctaatttcttggcagggtcatcatccagcttctctgcagctatagcacactaccactgtatgccattgtctcacaggtgagcgtggtagcaaactatgaattataatgaactaattggcatggcgccggctaatttttttcttttcttttctctttttttggttggtttaagatggggagttcttttaagaaggccatatttgatgagcatgtgcaagagggtcttgttagctgggctgagaaggtaaagaggaggaagggggcaaaagtgggcaatgagcttgctggattaagccgcagatcagcagaatcttctgtcaagattgagatgcagggactcgttaggaagaaggaagaggggggaggtggacatgctcacccagatatgccatagctaaatactcatgcaatccatcaattggccagcaactatgatactataacttatatatccacacttaatatgccagtgcacattcagaacatgaatcgcatatgttttatataatgcacatgagggtgctgttcactgagttcctttctaaggttggaataatttactggcatatgtttcagattaagatatggcaggtgccttcatgtggatttagttctactatattgttattgctaatgtagagaaatagatgacataaaatagttctggtaatagaagattttctacattagatttctagtttggttggtttcatttagatgttttagtttactgatcattgtgcgacttcatcaaccggagattttgctattaatttccaggtggttatgagtcttgacaggcttctgagtcattgtctgcttgatatttttcaatcatggtaatgctgatgatattttggcatcaactcccagtgcaaatagctttcagttctctctttatttaaaccaaaatagcttgtcttctgatggtgggttgggtcagtcctattttaaaatatatcatgttagatccacgtctttcaactaatttttatctggactaatgagacgcaactttactacatttaattcaaccaatttcacaccccatgcaattggaatgtacctgagcaattgttggaaccacgcaggaatgttccaaatatgagtcagattcaaacagggtctagaacaggacggattagggcttgcaagccctgcttgttcccttggacaaacttttgttttgtgcaatgcattgcacttatgtctaaacttgttgcaaaaatattcagaatgaagtaatttacaaagggctagccctgaaccaaaatgttccatatgttcaatttggatcaaatatgaaactgatatcgggattatccatatccacaaccgactcagatataaaggtcataatcaaacttgttttaaatggatacaagtcaggaaattaaatattatgactgccaaataaaagatatcatcatgtaaatggtaaattaagttaataatatattaatatagtcacttatctcataaaaactataaaaaattatgtaaataaaactggatactagtcaggtgctcaatgttatattgatatccaaatagattcagatcccaacagaccatactagcacatcatagcatccgatctgcagggctgcaatgtttatactttttagcatgttatcttaacaaatattttagcaaccaagaagcaagaaagagtttaataatgaggtcacgttatgaactgaaacatgatttcaccggcacgatcccccacatctccacaacacagcagaggtaactgtttaaaagcatctaaaaatattgttatgttaagaagaaaatgacttgaggcagaagatatcaaaggaacaaatattgtaatacaacattttgttctgcacaatgctatatcataaagatcagctgataatattgcagggatgacagaatctttcactcctaccatgttatcattcttcagcagcactcgccgcactcagatccacactgagatcaacatcctgtggcaataagcttgtctttagtatatactaattgagaataaatgctagacttcactatgaagtgaaacaagagtgttacaggggcaggatgctactagagagctcctaataaaataaagcagaaattttagaaactaaaaatctcttatacagcaggtggaagcaagaaagactcagaaaaaagagaacaaagtaacacgtatcatcttgagatggtatattatgaagaaaaaccacaggaggaaacctaaggagacaatagtgtgacaagaatttatatgtcttgccatgcttggcttaacttgacggtagtattttgtaagaaaaagaatgattacagagaaaatagggcacaaagacacggcaaagtcattacctttcctgtgatcatgcgatacatgtgaagcacatccatgacagttgactcaaaatgtgtcgtagcatcataactctgcagacagtgcacttgtcagtgaacatctgcaacatcaaagctagaatatgtatcatcaatacttacagttgagatgaagcaattatccagtgagggttcattgacaggtacagatctgtcataagtttcaaaaaatagctcatctacaggcccgagaaggtcaattcctggctttagttctatctccggatgatcagtctcagcttctgttgagacaaatgcaacgaacttcccctttggtgcaacattgtgagaataagaacaacagaagagatacctataaaagcatacaaaatggaaaccactatgataggtgttgcagaaatagtagagaaatatcattaagaattcaatgcatgacatgaaactgattggtgcttcatggaagaagactgacatgtctgacttgcgtcccagctgcttctgaggcagaataacttgcgctgaatgagagtcatcagtatttgggatgggatgactcataatggcaatcgcccttgcaacctttccaaccttcctgacctgtggccaacgagtgaaagtcctatagttttagtgagtggtcatttatcctcaaaaaccttcctatataaaatctatcattagttctgctgctaccagtggcggagcctggcatcaaatattgggaggacgaagtaataatttattaataaatttttaaataaaatattttataataaataataaaataaagatatatatatattcaaaaatattacaaaaatatcaataaatatttaattttatgtataaataaagatatgtaaaaatattatattatgccatctgcaaaatgattttaattgtgtaaaaatctcaataatatcttccacattaaaggttgaagaataaataaaaagtcaaagaataaataaacaactattttttctttaaaaaatttactattttaaataaaaaaataatatataaatgattttttttcaaactagtggattcgtaatgtgtgtaagactaaaatattgggagggccactatatatatataaatatatagataataaatattttaaaattttttggagggacagtggccccctctggtccctcttacgctccgtcactggctgcaatacgatgttctgaaatgaatatgctgctgatcaagtcatatagtggcatatattgtccagaaataatggaaacaaatttacatcctaaataaatcacagatagggtacattctcagatagcatcagatagaggttgccaaaaaaaacaagaatgtttaccttgtttggtaagtaggaagggtcacacacgaccttcttgcacttagcagtttccccttccgatgtcacaccacaaacttttccttcaacatcaaattcaacctggcacaagtgaacttaatgcaatctatcaggaaaaatcttcattaagcaggacaaatcagtatcattccaacatatttgtatgatcatttataactatatttatactttcataaatcattagaggtgccttggagcaacagtaaggttgctccactgtgacctgcgtgtcacggtttccaaacactaaaaacagccccgccgcacatggggtaaagcagtatacatctgaccctccccagactccgcagtggcaggagcctcacccgttaggacaccctacttttattctttcataatgcaaaaaaaaaaacatggtgagcatgtatggcagtaataaaacaccttgcactctggtttatttaacatgtacgtcccaccataaacagcactaaggcgagcaaaagcctgtaagtccaacaaacacctcaagttaaatagatcatatattataaaaattagaatgcattctggaaatggccaacctgtggtagttctcctaatccatataaaggatagatatatggtgaccctccttgaaaacgagccagagattctgaataaagctgtcaaaaatgacaaccaacaccatgagcaacaattctatcccagaaataatagctttgggtggtgatgcaagtccattttgaaaagaattaaaacccattctctgattagatacaagaaggatgattcctaagaagagcacatgcccatgaacaaagggtagtgatgaactcaaagcacctacctggcagctcagttgagtccggtacggtgcatattttgctaaatcaaaggatttgaatacaaaggcctgttctcctaaggtttatttttgttaaaaaaaaaggaaaaatagaaaagcacctatgaagtatccaacaaaaatctatatccgagaaacaacttgaagaatagaagatagatggtaccatatttcaagatttaaaatctgaaacttgagaagcaactaaccatcctaattagggcataaagctatatatgtccttagcaagcatttccacctatgagcaagactgcattatcgagtaataatagataatccatgcacattctcgaaaagaatcaagatacatgcaagagaagcacaagaaaaaagtgtatatgttatgcatcatatattgataatacatttcatctttagttctccactctcatgaaaaaccttgtcaacaaatacaaagaaaagatctgttggatgagtgaaagttacagcattcttataagaaggccaaatcgtcaactatgatatgcggcaaacagattcactccctttgctacttttgtgtcttgaaatgtccaaagaagctacctactaaaaaaactcacgagggcaaagttttataatttttacctatataccacaaaataaagacgatatatgcaactagttcaatagcttttctataaaagctgtagtcaggaaacatggaggatgcttgatggcaatggactaagagttgggagagatgacttcatcatttaagcttcttgtgctttccgaacctatttcaaggcaattaagtgtttagctggttgtatatattgggtcagttttatatccattaaaccaaccggggaagcatgtgcaaaataaagaaacagaatgccatcttcatgggtccaaaaatacaaaagtcgaatcatgaatggatttttaaaaaaaataaaagaaaaaaattaacaaaaacaataaaaaaatcttactgcataataggtggttgttttgagcaatcaagaagagtgtacgcacttagcaacaacccctaccttcatcctttttacagtatcaagtgcaggttcatctagatagcgatcatctctgtgaagagccagtgcatgaccaatgaagtccactgtattgtcatccagcccatatttgctgaaccgaaaaaaaaaaacaaaggaaaaaaggaagcagaatgaattgcaagagcaaggtataaaaatgctgctagatcatattgtggtatcaaaacatcctgcccatttgtttctcacagaaagttactaacggacatgaaacaggctaaattaaacacagaaatccaatggcaacaacacagcaatattcatcacagatacatataaaagcaatcagaatttggttaagctattagagttaaattgcaacgaagagaatcttattttagattgagagaatttgacaaaaagagtcaagaatgtgtcatgaattgaggtattcttaagaaaacatgtgacgttccgatatcttatgaagttcaaaaaaaagagcagaaaatgcttgttggatggaggtgttgcacttttagaagaacgtgtgacattatgatatcttatggagatcaaacaagagcaagagaatgtgtagtggatggaagtgcctcagtagttctgctatacaagatttaaagaaactacctcaagaagattttggtgaggaggcattataccagctgaatagcagaccgcagtttcaagaaatgcaagggttgtatcatgatggtttttcttctaaaggtttgcaaccttataaaataattacacataagatatattctcaaattactaggactacttccctaagtggaaaaggtggaagcattataattaatgagtagagaaaaggatcaaaagaaaagaagactgggatgaagaaaaaagtggtctccctatttcaaatatttactcagcattggaggatcctagtccaactaggactctcatactgagaaaagagcagaaatgtctaaggatttcctttggaatttaaacaaacaaacgagaaaaaagtgccagccaggaaagagacctctttctcagggtcctaatatcctaattcactccttatctggccatatatcatcttctattttctttctcttttttgaaaatttcagaaagaaaaaagattctcgagagaaactaccacaaccaccataaagtttttatatgagttcaggaacccaatttgtctacagggctcttcattctgaaagcatagattgcttctgagagacggttcagatcccatacaaatggttaattgtaatgtgttcaaacgagaaaagactcttaaaggaagatcaatgacagaccatgctaaggtaggtacagaggaagtcgacaaatattttcttgtagttcatttttatctgtttgagtccctggaggctacattgagttaagaaaaggaacagtgctcaaccattaaagtgactcactaaaggtatttttctttgtagaaggattaatatttaaatctttagggaaacccttgtagtaatcaactagtaaagttaacatgtgataggctagctatctcgcaacatccagacatgtaggttatcaaattaaaaacaagaacttcttctctatttttatggtgcaattctgtgctataaagcaagaccttttagtgctaagtgtcatagctgatgcaaaaccgttatttatcctctccccctcaagattctttcttcttaaattccttatttcgttgtttaattttctagttgatcccttttagcatattcctaaggttctttaatctcatataaatattaattttaatccctattactgtccactacagggctcttgcttggatggtatcaccttttgcaatttgggcaagggagcagacttcaattctggttggagccagccacctgagggtggggtgatatggggcaaaaaacgtggggattagctatcctaatttttttaaaaaataaattactttccacacctaccttcaatgagtaatattttattttagtctgtactttaatttaaagtatattcagattaaatataaaatttcctcaactcaagttctagaacttcttggctggtttttcttaaaatttaatatcttattgctcataaatgagttccacagatattgattgacttattaaattgagccttcctttttttcacttgttaaaatgccatggtaatgtcattctttcagcaaagcaatatgtaatacaaaccaggaattccacaaaatatatcacaaacaaacattgtattgcaaaaagcagagcttcatagtgtggaagtgatagatataggtaacagtaattaggtacccacgagataagtgctctagttgtcactcttgtaagatccaatccctcatgtgtttttggatcattttcatcataatcctgaacataaatgataaatttccgagctcggcgcttctcaaacaaacccatcaatggagatttgagagcttctatatcagttgcaggaactttgtgaatctattccaatgagaaaagagcagcaggtattaaacaaaagcatcatcgaacactcagaaatggtaacaaattaccaaaaagctaggttgctcaaacatggaagcaactaataaagcacacaaacaagtatacctttcctttattaaagacatagctcccatctgctgctttgaaggaaaggtattttgtaacatcagtatgtataagaacacgaaccaaagtaccatttgccatcatgaactagtcagacaaacattaattaatcagttatattacaaagaataaaagaattataatagaatgcatgtacatcaacaagattgttgtgagcactgctaaattgataaggcaattaacaaagcaagcaagcgtgtgccctttgacattatgatatgacagtccgacaaataattcatggttgcaaataccatcatgggcttgcccaaaatgaacattttaatcaagctgaattctttcattataaggtgtacaatttaaccacaatttgcttgcccacagtttattcttctgcaaagacatctataatatgaaaaatgaaaaaagacgtaatactattgaaaataaataagtagaacctttgactgatggtgttgtggatccctagcataacaaagtatgcgctgtattttgttaactctacaaaacatatagctgtttaaaagttttaatagcacttgctcatacttttcacctgcaaggatctctttaacagtatggcacatagacagagtacccacatgctatgctagacaacataaatatcaagcctcatgcaatctaattgggtttcatgtaacgtgtgtggattgtaattcaccatagcttgcatgtaaatccaagcattgtagattgaaaatcacttccattttcttcttgtcacttccacccaagtttttctttccccctttccttcccctcttctagatccacaagttatgccaaggatccttggtgaccatgtccagactggcagtctctcattaaatctgtcagaaatgtcttaatagctcagttagtgagccttatccaatgtatagctggttggttttatagattaaaggcacaccaaaagtaccacaaatatacaaatttctgagttgacactctctacctttcccacttcttaatatattctgctttgtcaaacatttcacatcaatgtgcccttcatattgcccacagtttcaataaatattcataatccatgagtatcctgatgctttcagtaaacagagattagaagatgaaatttataaatgggtccagtttcttacaacactcattaacattctcacttacattctgctcaagcaacacttacctaagaggtttatcctatgaaactacgtcttccactacaatgttccatcttgaagtgccttgtgactataaagcctataaagatacaaattatataggaaactttaacattgaatatggaatataatacatggaagttcttcaggttaaaagttttaaatatcagacacctttctgggaacctcatgtcacgctattatgaaatgtacaaaaagttgaattttcttagttttttaaaaccttgtaataaggcaatccagtaaagaaacagaagagggaaacaacataaattaagagcttaaaaagttatggcactacacaaactgtatactggttcaagtgattgtcaatcactctgcccacctcatatcactagttcatcacgaccatttatcctttttattaaaacaacttattgaagtagtctacaagtacgttaggtgaaattcagcttgtactattttgtgacataataaatcatgaattgcaagaatgccaaacaaacagacctttgggatcatgtcaacattgtaatctctgctaggacctaaatgcgccggaggcttatcgctgcccctaaaccttttccagagctgcacaaaaaaggatgctttagtcagttaatattgctcacgatgtgaatgtaaattaaaattaaaattaaaataaaataaaatacaataaaaaaacttttttgatacatagcatcaaggatttcatctggtcagacatcttggttagtatcaggcacccacctatatgataaatagaaaatatcagaccttatgatatagttcaatataaagtgatagattccaagacattggatggtccaatattaatattttggcctatattttccatctaccttcttttagttcctgaaatagatgttttgactaataaatctccaaaatcaatgtgtaaaaatacttgcaaatttcagcccattgatcaagattttcatatcttctgatacatcagccgagaactcagaaaatcttagatctttccaagttttctgaccttctattagagctgagataaatccacagctcagttcatctcagtcttggtcacacatcaagataatcgatattttactctttaaaagcctacacagtggcattcatctttaagttaagaaagaaattgctgaagtctttttatttatatattacaatgaatggtcccaaattatagtacctgacagtgacttggagcttgctttagtctagcagttttttgtcagatggtattagaacaacataagaccataaaggtgatagatttaaacaagtgtatatatcgtgcagtaagcatcagctatttaatcatcccagatcaggtccttgcctggatgagattaagtgaagatgactctcctccatagtaatcattcctgtccatgtgcaggacctaatgcatgatggaaagtaaaaatattgttagaaaccaaaatagcaaactgcagatataaattttagaagattttcataatttctcatcagaatagctgcacgacatcttctgtcaaatcatgtataaatgttcttaacaatagctagaataaagtgaatactcggtgtcaggtatgtatacttcaatcactctgccgaattaatatttaattttcagaaaaaaagactcataaaaatcaaataaagacaaaaagaagtctagttcgttccagatgaattcatcaaaacttttcctgggcagcaataaaagtgtcaagcatcagattgcaaacatgctggaaaccaataaatgacacaattatgaaacacccatgtttatctcaagctaaggttctttttaactgtttaaaaacttagaaatgtacttaggcgatctgaagataatctctgatcatggtgcaactatgacagtacaataacaatggcgatgttcctttaagtcagcacataaaactgatcaagttatgattcataataaaatgctaagttagcaagattgagcataaaaagaaaataaactgttatatttataaagtcagtagaatagcttttcattggttcaggcatgccttctagcaatgcaaatatcatgaagaaattgagagaaatgcacatatcttaagaaaaaaaggtcatcaaagaaaactaaggttatctattcacacgctaaagcacattcgaccaagactatacggaataattgaaagcacaagcatcacaagccagcaagtaaacaagaatctgacctcattttaatactgctacaggcatcacattaaatcaagtgatcaaaacattttcaccattatggagcaatcagaaaaccaaaagacaaaattgggaccaccaatagaactccaataacctctcatcccacttctcaagtatcatctgaattgatagatgccgcgcccttcatgcaaacgacttaaaagaatacttgctatatatttttcatgtagataacgggatagcacaagaaataccaaatctatatcaaaaccagaacaatccgctccacaaaacacaccaagatacaatcttttaaggtcatttcagctatcaatcataacaatcataataaaatgaagaaataatcaccaacataacacaaaaggagcagtccgaaaagaagatcttttaggaatctaaactcgatcgccaccagttccaattacatgaacggcatcgccaacagatggtgacagcacccaagattcaaaacaatggatcgcgtaaaatccaaatgatacaacagatcaagagagagaaagaggagaccttgaggccatccacggatagaaggccgctgaggatgcactccttgagcccggtcccgaggactatcacatcgtactcctcatccatagcgaggccgaagggagcagagagagatgagagagatcgaggtggagaaaggtatcaacaaaagaaggaaaaagggggaagagacgaggaggagaagagagggcaaaagcaagagaaaggtggatgctttgttgagctacagaagccagcagaggactcgattagacaggaaagccgaaggaaggggagttgacaaaaatacagggggaaaatgatggacaagatattggttgtggtcacctatggtgagagtgtggatgttctccggggtaattttttcttctggccaaacagtcaggatattaactttcagttaatattcatttcaaaatataaatttattaatttttaaaaaaaattaaaaaaatattttggatgggaatgaaagttaatattattaaaattttttaacagaatagttcacgtaatttacatataactcttcttatatctgatatggtatagttcaagaaaaaaaaaaattggattgacgtgttctgacttgcaccattttattaaaaaaaaatttcaagagaacacccagcctcgtacactactcaaaactttcttcttttctccatcgcttattgtgaacgacacatctcccccaaatctgatgccgaaaccctaatttttaacgattttcttttggcagatatttcttttttgattgagatccgataacgaaagcttcagtttatggcagctccagcgatctccgatgagggaaccctaaggcttcatcgaggaggcaatgagagatattttcactcgatcggagagttctcgatcacgatcgtccagaccaacagggttttcgaggaccacaatcagattgagacgagacctgacaccaccttcgttggggtctatgacggccacgacaagctttacgcctttcacttcatctctgatcacctttttcttcatctcatgagtaggactctttgttcgacatctattgttgtttttaaaattttctttttatttcttctcatcaactgctcagaaatgtttatttcactgatattggacttatgaagcttatctttatgtctaaaatgtttctcaaggtgtgttctttattttttttattttttttatttttttgataacatgacttgcactagttggttccagccctcgtttataaacagtcctttctttttttatttttttcttaagctatgccatgtcagatataaggagagttatgtgcaagtcatgtaacctattctgttaaaaaattctaacagtcttagctctcatccttatctgaaattttttaaaaaagtttgtccttctttgaaaactcgaagaatttttgtcctaaaatggatattaactgaaagttaacgtcctgaaatgactgtttggccttttctttttattagcacagatagtggccttaaaaaaatctaccccttgaattttacatagatttacacatattctctacatatcaaccttccattttaacattattgcaatactagcataaaacccgtgctacattgtgggttttaataaatagaagacagagtcaaaaaaattctcaacctgcgatgccttcaaaacatttgttaagaaacatgacatagaatatgcttgaattataaaaatattcatgaattataaatattcaccaaagaattgaaaattattcttttaattgatgttccctaatctgaaaacatagttggaagaatagaaaattaaataataaatagaagagctatagtttctttactttataagcaccacgattagttaatttaaaaagtattttttgataaaaaaaatcttcataaaagagaggattaagaaatgatggatccttaatttttattataataagttcattagaaaaaaaatcttcaacgaaagaaataaaatttttatgcctcatgcaagaaattaaataataaaaatttaaaaaaaaattagtttaaacataagaaaagaataatgccaatttaattataggaaagcaagaaatcaaaccgtatatattctttttttaaatttaaagaaaaaaaattattcaacccttcctcttttcgatcatttatttttatttttttttattttcttctccaattcaaccttctctgtatccctatcttaaccctaaccctagccccaaccctaaccctaaccctaaccttcaaaaatctaactctaatcctaacccttagcagaatctaaccttaatcctaaccttcagcagaatctaaccctaaccctaaccagccacctagccggatagctaaccctaattagatcctctatcataaccctaaccctaatcggatatgctaacctgtcagtcgaatgatctatgacccatttggcacacctgttaactgatctgcatggattccatcacgatccattcttaaacccattaatctgtatcttcttttcctatcttaatccatttatttctttctattcatcaaaccctaatccgattcgtcaaaactaatatatatttttctttctgttcatcgaaaggtttcacagcaaatctctgttccttcctttttctattctctagaaagctgccgaatcttagcagcaatcatgacattttttttcttttatgtggatgttgaggaaggatactatagtatggcagcaatcatttgtttttctctttccttacataatgtttgtaaataaggagtggaaggctgtcaaaacataggcagcaacccccctgcattcttaaaaagaaacagaatgttctttctaatattactgtgaaagaaaaaattaactgatgagagaataaaaattataaatatttaataaaaataaatccaaaaaataaacaaagatccctaaacccaccttctctagctctctttactcgatttttcttatctgctgccaccatcttcgatctttctaatcctcaataagtctgatgaaaaataataaaagtagcaattataaatagatccaaaaaaaatactccccacctcactttttctattcagccgttctcgatgtttgaataatgctttgaaccttcccacatatatataggctaaagtataaaaagaaattgataagataatccatgctttggcatcaatattttttgattttttctcaaaaatcttctctctgagatttcttttcatccaccacattcctcgctcttttttttttgcgggcgcctctcttgtgatagaaaatgacatgggagagaagagacgctgcacatagagctccatcccattcctctctttctttctttcttttttttgtgtacgcctctctcatgatagaaaatgacatgggagaggagagttagagtagagccggtctgctcagccattgggagcatcttcgatccatccaatccagatcgctatcttctttttcaaacgaagcatcatattttttctacatgctggatgcacgccatttgtccccccatggatagctgacacttgtcgcactgaggaggctttggtctcaaatttaatgtattgtatatatgatccatctcctcccaattcaaattaaggttcgttggagatgcctacgtgccagctaatgtggattcatgattttgatgtggattcaagattttgatatggaatcaattatttgatgtagaagttatctccattagagcaaaggttaggatttaggagaaagaaaatagaagacccctttatttaaagtgaaaaccatagtgtcatccctattttctcccctaggctttgaggtcaacatatgttccaattcttagacagtcattgatctaaattcaccaaatccatcaagaaacagaaccaaaaagaaatggaatgtggcaataataatataaaagggtggtaaaaaaatcaatagtatattataatagtggttgcttattttattggagcttatttagtatttacgcatcgttcaaaaatctcatagtagtcacactcttcccaaattttattagaccagctcaattggaagcttttttttaatatctgtctaaaagttgctatacaaaatacttgagtttcttctattcacctcttggtacaagaccaacactaccacaataactcatcatggatcattacaatgaactcatctgatgagatatcactgcaaccaactcatctctcatcggctacttaggtcctagcaattgcaccacaaatgtatgcaagatagttttgttgctcactgagactttgtaatccactatactgatatgtaactccttaagaacttagattactttagaaataagatgggtgtccatcgggcaacttactcggatgattgccttattgtgcacagcctggctcagggcactatgcctacctctttgatctgctaatgtggattctagcaactattccctcacaacctccattttcctaggtttcttctagagattagtaatgtaagttatggcatcattaagaaaagcgacctttccatctttggatattttgcattatggcactgggaatatagagcctttagttgagcttctcccccctctagctagcactcagcctaaatatgattgaggggcgcctttatctcatttgttagcttctagcctatctttcttggcccctagttgtccattgccctcgacaacttttccttgtatgaagtcttcacatctaaatgcatcgactcgaatgcacccaattgagtaaccaataacccaaaagccctcaaagtcaccctaccactaaaatcaatttaccgattgtgattttgacgatggttattgttgctttggagttggaaactagttcatgcaaaggtctttcctcatcttgttactgtaagaaacaaataccctaggtgagggatccattttgcaactgccaatcataacaacatcattatccaacctttgtcgatgagaatttttagcataaccacatgtctcactccaattcaaaccataaataataccattggagatcgacatcaacaccagcattagcaccatctaacgatgatgatttctgcaatttggttggatctccaaatgatggggtctcatactaccccctttctgtgcctcctcctcccttccatccggctccaccactggtgagatcaccattcttgttagttcatggaatctcttttccttcttccaaaccctaaccttgctctcatggagatagcttcaacgctagataactaagtctacgttagatacctaagtccatatcaaatataactccctttatgtcagctgcatttaggcatcttcgataaaccctaatttgaattggaagaaggtaatcatattgcagtaatgtatgaaaatgtgagattgatattacagtagtttaatacgtagagagattgacaatttcatacaaaatgcaagggtcatttttttagcctagttagtgttatccaaattattcaaggttttttgaaatgtacataacttcatatcttcccccagagatgaatggtcctttgaattattatctagtatttgaataaatcataatagatctagtaaataaataatttatggtgtttgtgcaataatagatagaaatgatgatatatgttttgattttgtatttggttagagccttggttatgtgatataagtaagcacctagaccagtctaatcatttggaatcagtagttttacaaaatgtattcttcagctttagacaacataaaaagctcctcgatttatataatgcatgataggtatttgctatataaaatgcatttatagatcttcaaaatctttcatgatagattttacctctaataattggagtaaaggaaccactgatcaaaactttatgatattaataacttagcgtagcactattacactatgttattgcacatgagaggtattgtccttttttttgttatttgttgtacaaaaattgatgtcaataatctatacctttcaagcaataaaattactttttaaaatttagattagtttcttattcttaaaaatttattggtatgaacttatgactccaaatcttttgactatagtgtggtctaaacatatctatactatattgttaaatagaagaaaaatacatcattttttattttagctacaaatgattaaaatatattttatcttctcttcatgaatcgaagttttaacttcgggtccacttgaaatacagccaagtcaaatcgacatgataagttttcaagttgacttgatagaaaatttggtttatgtaaaattcaaattttggattaatctcggctcaattgacttaccaaattatttgaaacttggttcaaattgtttgacttggtaaagtatttaaaactaaccacaatctattttaatatttttttcaaatttcactcaaaagagttattgaggttagctttccatatttttattataaagaataaattacaaaaatcctcctgagatttacgtttattacatttcaaccaatatgttgaaaaacctatatttacacctctaagaaataatggtgttacttaaaaatttcaaacttctgaaatgaccaaattacctccgagacttaacaaagcaaagtggacctaggtggagcacagcgactagggcactgtcgaggcatccttcttcccatgcggacccccgatctcaaggaggtggagggggatcactttagagtggctgatggcgatcttgtgctcctccacctcgaataggcaaaggagggcgatggcagcgttctcgcgggcggtaggggtacagtcttgaaggcacgggagagggagcaggtggctccgatggtggtgatggggtccttgttctcgtcatagaggcagaggttgagaatcgcgatggcgtcgtgctcctagagctggaggtttgggtgggaaaggagggtgatgaggggatggatgatgtcggcatggccgatctttaggcggttctttggattgtgttgagccaagaggtgaagcatcatggccgcgtggagctgggtttcgatggaggaggaggactctaaatcaaagatgaggccacggatgagctcgtcgaagtagttgacggtgcaggacatgaggaggtggtgaagggcggtgctaccgttggaggcggagctagtgaaggaggggaactcgcgggagtggttgctattgcagtcgctgaaggcatcggaggagtcatcactatcattgaaggtgcggcccattctttcttaccccccaccaccaccatcgctaaaggagtcatagggacacctccaccaccgccactggctccgttgtgatggacacgagcctcgtggaagcgggggtgtggtgtggcagtgttcaaggtgaggaggaaggggttgcaggaggtgggggaaagaggctgaccactctaggataatggagacgaggcgagcatgggagagaagacggaagacggcatcgtaggtagcactagagtagctatagctgggctagcagtcggaccagtccaagaagtggaggtagaggaggagatggtagagggcaaggcgatggtgggtaggactggaactagatcgagctaggctgggctctacccctacctgagcctggctcaaaaaatttttttgggcttcgggtcaggtttaagcccgattattttgaaaaaaaattggcccgagcctaggtcgaagctcgattgggccaacccgagcctgccttcctttatttcgacttcgctaggttccatggcctccactgaaaacttgttggcatcgccgcctgtgttgtccccgactcccaaaagcgaaatccatcatcaagaaataggttaggattacggatagtgggattattgagattttggcgggtgtagagcagaaaatcgaggccgaagaggtgggagagggagtgaacaaggtcgacaagattagaggaggggaagacctaggagattctgatggacgcatcctcctcctttgccttcctcttcgatttatgtagctttgtttgatttaagcgactagtgggaggaaagcggggagggaaaaagcagaagcaaaaatcaggggagaaaggtttttttttggagatctatgggaagaaaatcacctgaggaaaagatcgatgtcgacaatgatggggagaaaggcgacagcggagatcaataggaggtggcagcaagcaaagagagaggaggccgatgaggaaggccgatgctggtgcggtgaggagagcagagggaagtgggcatccgtgagagcttcgatgaggagagaggaagagggctcgagagagtgtcgaagaagccaaaagaaaaaaatatagaaaggagagttcaatcctcccccttcccacttccccttcagcctgggccaaattttgggctgagcccgaccaaaaagcaaaatgggctctattttttggcccgagcccagcctaaatggttttgagccgagcccaaagcttgaccccgaaattggcttagcctgatgggtctcgagccggcctgagcccacttctagccctaatggcggggtggagatggtggtggagggtctagagcactcagagagatgagaccaaatttaatggagatgaaggttctctttttatttaatttttttattcgagattattttggtcatttcaagaatttataatgacatggcaatgaaattcaagttaatattaacggacggtctaatggcatgggttagactgtaggattgactaaaatattaaggatgtaattatagattttgaaaactattggatgtacctattatttcgacctattttctgaaaaatttttgtaatttattcttattatgaaatatagtaatataagtcaaacaaaaaaaattttaggaggcttctacttcttacatgctaagaatctctataatgatcgatcttttcatgcacccccacaatcctattatttgtgttcccattattagttgagggggttccattcaccatcccctcctaacactcgatctcaaaatacaatattatttgatagcacgttaaaagagtcattgacatcttaattttttttattttgattgttaattaatatactaattatatgttaataatcaattatagatttaagtcttatgttccatatataaaaatatatctatttatgttctttaaaaatcaatatttcataatagatatatatttaataataaatatcatatatattattaagtccttgtgttcgagacttatttggtattaccttgagtcttcgaacggacccaacttggcaaacttacaaatggattcaaatttttaagtttttaaactatatcatgaacatcctaattatttatttatattgatcacctataaagtccctcttaaataaatggattcaattttgtgtaaaaagaccctacctatctcttgtccatatcccaagaaattagaatcttattaaaattttaaaaaataaatgaaagtatcaatagtcattctcttcttcatgtattctatccatcttattccctaatcccttgaacttttttttttattttagctttttaacatagtacatgcatttgaacaatagctaaccattcaaaaggaaaaatctgagatagctttgaaagactcttttaattttgcattttcattcgcaaaaaagtgaaacactctttctttatttgatcataacactaatcttcccttttagtaatcataaatatcaatacttattatctacttcatgtattctatccatcttattccctaatcccttgaacttttgtttgctattttagttttttaacatagtacatgcatttgaacaattgcttgctattcgagaagaaaaatctaagatagctttaaaaatctctcttaatgttgcattttctttagcaaaaagtaaaaaacttgttctttatttgattagaatgctaatcttcccttttagtaatcattttctttctcaatctatataatcatatctagtttagaggtgccaatggatcacattaaacctaggttcgattgaaaaccatcaatccatacttgactcattagtaattggtttgagaagtataaagccataatcaaaccatttattttatatggatccatgcttgaccaaccaactcatttatgtcagtcatatgtctcaaataatgaaaaaaaaaaggaccaataagaagggatttagggttaaatatcttgaatgaagcaagcttggggaaagtttaagtgaagaaggaaaatagactcttagaaaattgtgcacttcatatttcttcttattttagattctcaatacttctaccgctccattttcataagagtggagaacccattattgtctcgactaaagaagtcgaaatatgagagaacttatattaggatgggcttactatctaaatagttttaagagttatccgttctacatttgactacttatcatttactatgagcaggtgtgcattccaagtcctcttgtaccatggaaagatcctttaaatgctctaacacatgcattggagaaggacagaactatcttttattgatttttttttttctctttactcttatttggattaactattgagatcacatcagacaagcttttactaacctaaatcctagcatataattaccgacactttagggtccttatcctagaatttttttttaaggaaaaatttttgtttcaccctctacttttcctaatttcagccacacctctctatcttaaaaattttcatttggatccttcacttacttgactatttcaatgagatcctgccatccacctcaaccgagcccttgatccgatcttagaaaaaaaattgtgtcacgtgatggctcaaaacatttttaagcctaacacggttgaggaaaacactggtgtttgatggcaaatatgtagataccggtggtggaggacgacgtagcggcgaggcgaataggaagagagatatcaaaagtatgtgaaaacaattcaaaccgatcaatagagcgtcaacaatcgaatcttttagaaaaaaatattcagatatttctgctaagaacgaaaaattcatcgaactacgctatttcttggagaagtgccaaaaattatatctttttttagccaaaaaaatttataatattttctctgcgccttcaaatggatagtgttgggatataccgactgatctcatacaccgacttatcctcggatcgatccaaccgacacccgactctacccaccggacagacagacgactctgacaataactgccgacagtatccgaccgaagatatgccggtcaaacagaccaatactgtttccaaccggccgaacggccgaacccatatcactaatttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggattggctgcaccagatagattgcatcacggaaagaagaaagatgaagggcggatttgcgcggggttttggcacctcttgcttctatcccggcagcgatgtcaatggtaaccgtggcccttccgctgccacccaggccccacggcgagtattgagatccccatgaagatcggatgtcgaggagttctaccccgctgtgctctcaagagatcgaaagcatgagcaagagcaagagcacaccaaatgtttgatgaaatacccctctagtggtgataaacctcttgcaccgtttgcagggggagcctaaattcttcttcttctttttttttctaaattgttctctcctcttccctcaccacctcctttccttctgcacactagcgcccgactcatcgcctacagcatcctcatcatggagatgagtgagggtctagaaataggaggtcaaagagatgctcatggcaccaagaagtggagacggatgtggttgggtccttcgggattgaagaaaaagcggaaaaactaacatagccagtgacagtctataggtatcaccttgtccgaaggatgggttcggattattctttccctattggtaattcttcaacttttacctcattttgtgttgcgttttgaaaagcttgcaatttttggataatattgttggtagtttagcgtgaatgttggatatttagtggttgctgtggttgtgattctaattggttcaagaaatattttatgcatggccattctaaagctcttcgcttttttgactatatgattaatagtgatctggatattagctagtttctcttggaatgccgatatttgtgtcaaagtttaatattttatttcttttcaagtttttgaattcatgattttggagaaatatgcatccgagagtgatctttaagcatgcatgcatacattgtcctgtgcctacttaagaaagattttgatgattcatgaattagaatcactaaaatttaaagaaaacaaatcaagccaatggaatataaaaatgatatttatgttcaacaaaatcttattcattaaatcaatccatcctaaggatcaactaaccacccaaacttaaatacagtgcaatttcaggatcgtctactaaaacaccatatgagtttggctttgttcacttgaacaaggtttaaaataggtttactttggaggtcttgattgtaaaactatgggtaaagttgaggtttgctccagttgatactcttgcaaaaaatatcagttagtctttaattggattgacaaactgacatgctagtgcaatttggattgcaatcaaatacccaagttatcaacctaaagttgattcaaaatcacattgtgttgacatcgagcataacccaggttagttatatattaacttaatccaccctaagttacaaattggtcggattaggattgggtaaaattggccaaagctgcacccttctgcaagcatatcggattaacaagttttataggctagcatttctctcttctcatgcagctcacctctcaatgactcggccatccaaccaccgttactcatggtaattttttatttctaaaatttaatattattgtgtatcttgaatttttttggggcttatgagtgagatttcttattgtgaagagacaatacgttaatgagcaggcgaatctcttcaaatttagtagtccgtgggggtttatatgtccaagagaagtgcataaggattgattcatttgaagccaagtaggccttattgcattggttgagatatcatcacaaatgtaacaattttgtataggaaagagcaatgcctattcttaagacctctataatttaatttcttcacaaagcttatctattccctcctcctagtgtccaaaaaataagaagaaaattcccatctttatctttttacttatgatatgggcaatttctaaaaactattatagccctttataatcccaatagttttttttttaaaaaaagatgcaattaggaccatccgctattttttttgaaaaaacaatcatgcatgacatgcatcaatgtcttactaatattaagaaatagtaagagaatctggtgttcagatcttatgaatagaaaatattaagaaaaattttctaatgcatcatcaactaatagctcctcggaaaaaatagcttattcaatatttgaacgaagataggactttggtggcgggctttttaaattgatcctatagggagagaatggaagtattattgtatacagagaagggaacatgcatgatttcatagcaatgagacagttagagttcttttacaagggaaatcctcctattttgtaaggaaaaattcttcgaggtctgaattctttgcaaccaagatggcacttccatgtgaggaaagaaatggagtgtcctttggagaggatttgcactaagaatagagttggacatttttgtttattagaacaactcttgcaactaaatgcaatggaaagagtagaattggctctaacataccaactctagattgaatactctctgcatatggaaccatttctagatataatggcagtcacatatggaatctaaggtcaatattaattttcattaatgagtcacagatagttcaaagatatgggagttgattgcaggatttagagagttgggagttgtttaaaagacaaggatattatgactggaagagtgattagtaagggaggcatgctttgagacaaactctagctattatattgagcatttggaagagggatattttgcgaatgtgggcatttcacatagaagagacgttggcatgtttatatagttttcaatatatacacacacacacacgtacatttttatatatacatatattatattaatttacattgaatttggaaatagggagtttgtcattcaacttggatgaagttcttatatcaaccatgcttttattttgtaaggtgcagggggtatggaaaggtcggtgctagaggtgataaaggatgtgagtggggcagtagcggatgctgaacaagatgaaatagggattttgcggtctaggagattattggctagtgggccatgtcattgtcggagggaccaagcatagctatcaactagaggaggcaatgggtgtggaggctataaggagacagagagagattaaagggttggccaaaggttaaggaattattctattctagatgggtagtgatgcatgggtgaaggataacctaggaataggatattatgattagcacaaataaacacataatttattgctctagaagcatagcaaacaactcttgcattataatttttcttatacgcatgacccattccacatatagtattagatggtctaggaactaaaagtaaaacagtcaacaaaacaaagggttggggatagaatttctgcttaaaaggttctaaacataaagtgataatcaaaccaagggtcataagtaaatttctccaagaattttcgagggttgtttggttgccatttgcttccatttaatttaaaatactttggagattttcttttatcgacttctttaatagcattaatatcatgcttccatgtatggaagggtcaagatattactttgatcatattgcttgaactttgtcgggacacggcggttgcagggttgttgccatcagagaaatgggtgttcggcatgtgttggtcgatgaactggtgaaggaaatccgtcgaacaattcttggtttcttgagggaatcattattgagcaaaaatagtcattgttctttggattgcacccattggggaaaaagcctttggtcaaggaaaccgcccatggcagaggaatctgaggattctcagaaagataaggaatttcaaagaggggaacataggaagatggaggggttatactggaggtttcaaagggcattggactctcatgattgggaacttgctgagagcttgattttgtcaatcgatctacaatatcataacattgggctttgtatggtggtaagtagtatttggtttctatacacaccaagatttggacaaagctactcacttgattaaaaggattgtctcaaatggagcacatgatttcacaaaggtgacttgtcagagacgtcttttcttgcattgtgaattttggctcctctaaattgcacaatgagctttccaaataccaaaaccggcatgattaagaggtaaattcttactattttgattcccttgcatatataatcttagcaatcattgtattctatatttgattttgtaaaatagctcactctaatttttcgaagagatcaagaattgataattgtttcgtgatatcctgtgattgtgaagtctcatcactttgatttccattaccttgtaccataaaatgtggtgtcaagggtcatttattatgtattttgtttgtggagaactcattcaaattcctccgtataaatgacatattgattttttattactgaatttgaagtgttgtactcagtttgctacaaagggatatttatacaataatagctatggaggttaatattcatgtatgattaatttgtttttcttgttaattttctataaggtgaaagaacacctccaagcatataaaggctatgtgcatacgaaggccaattggagtgccaaccttgaaaaattcattgcttgggcatttaatctgatagaattccattggcacaatcaaaaaaataaggataaagatatccataaatcaatcttcgaaatccaactacaattgccagcatataattcttttttaaaaattgctagagaaaacattacgggacaggagtttggtagggcctttgatgcagcctactttttaatccctctcttgtctaactcagttaaccatggctggtcatctggagtagcaagagatgctgtaccggagttactaggtttcttggtggaggggggtgcagaaaatgtaaaccaatacttcatgaaagctactcgatttgggagcacagaacttgtaagcattttattgcaggtaatgtatcctacttttgcacaaaagcattttacctatggtagctctagttatcctttacttttagttggattgtaataatagtgcagataattgcagaaatttcttatcggattttaaataatattggaaccacagcttgcttctaatcagtggacatgattacttagacaagctctaattttcattattatccattctataaagaattatcctaattgatagtaggatatgggaaaaatgtggtaagtgattatctcagatggtgatatatcttcggtcgtaccaacctctctagttttttttcttttttttgggtgcgagggggggggggggtggaggtgggggtcacagggtttggaagaaagtcaccacccatttttaaaagagaacatgacattcataaaatggggcagacaggtgcaacgcgatgactttaactgagctataaaatcatttagtgatgagaatggaagggaaaccatccacaacctttttttaagttcaactcatgtttttgccaatgcatgtatgatattctatttgtaagacaggataaggtcgttgggatagtagcatattattttagaattctgaacataaaatgatgtgtaagtgttacttgatgagatgagaggacaatgattattaagatcatgttgccttgggatttactatatggttatgatattctattttggaggcaggataaggtcgttaggataatagcagattattttagaattctgaacacaaaaacatcaaatgatgtgtaaggcattacttaatgagatgagaggacaatgattattaagatcatgttgccttgggatttaccacatggttatgaaaatttattttttgatgtaagatcatggtaattgtcttgaggaagtgaaagcttagatgggctaatgggtaaactgacatctataaatgaaacatggtagactgaaaatgttcataacatggtaggaattataggactagatttatgtatacaaatgggctatctaacaatttttgcaactagtttgaatgaggtttctgctatgctaaaaatgatcaatgaccagcaatcttgatggatagaaatgggttagccagtaccatgagaaatggtagaattcaatttggttaaacttctttttttgaaatcttgtaataatgagtggaaaaatgagggaaaaatgaaggaaaaatataattcgctattggcacaaatgggagtccctaatactattatcattcctattctttactcaacttctatcaaaagatctactcttatccgctagcctcttctttctcttatcaagacctggttcatggatctaatcaaacaacaagagtttttcattagttaaatgtggccatttaaactttcatgatgcatggcattgatgatatttccattttgttcttcacacccttacactagcatattccatgaaaataggaagggaatagcatttacacttatcaaataatagttatagggggaccttcttctgaccatcaaacaatatgttattcttgaaaaacctacaaaaaaaactctccatataaccagttatgtaacaaggtttgcagatacccatgtgtagtgttccatatcaagcaaccatactatactagtactaaaccgatactcagtatgttgtgcatactaagtgtcaatatgccaaattgttccctataccatgataggcatactaagtgtcaatatgccaaattgacctccataatgagcattgctgaaatatactaatatggtaccagtatagatctaacaccatgattgaaaaacttcctccttaattataggaggcaagcatctctccacctataacaaagtccttggcaataggagatgtcctaagttatgtttggtagaatgctaaatgttgggtggatgtctggcctggacaccacctttcaagaccttttcagtaccacgcgatgcagcaggaagaaagaagaaacaaaacaaaaataaaaaacaatcaaaatacgtgaatctgacacaaaagggctcgcctccacggggcatgcaaacttcactatgaaaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacatctagactctgtttcatattggttgtctgcaaggttactcattgatttagatattcttttgagaaggattagttgtcaggctacaacaaaaagaccttgatagctagcctttatttggaagaggttaaggttaacggcgatgatttatcatcataaaatacaggacaatcaagcataagtttgatgccgtggaagcatcataaaaatattaagttggtactgcataggtggatcaaggtggaggacttccatgaaatgaaaaggaaagccaaaagtcatcctcttgagaatttaagcatctgcattggaatgcaagtgaaataatatagcttcttggacaaaggaagatctccttagaaactagtcttgattttccttactcagaggtgctgagaattgcagttccaggaagctcttaggtgaagtataattttgtttattctgaggggacctatgatactaccttgaatctcattcatttttcatgcaaacaataaaacgcatttgattcattcaacccaataacaagaattcagctggcagcttgagtcacttcttgttccttttacaatcatctctgcctatctaatttcagcctacccccttttcattggactatgataccatatcagctgtgatacattcttctgatagaatgcactttgaaaaggaaaaggtgattggcttgcttttaggacaagctgcaatcaccagattgcataatcagactagcaagtacaggaatcccattcatctccaaaaaaaaaaaaaaaaagaaaaagaaaaagaaaaaaagaaaggaagacctgatcaggtgattagaaagatgtaagtttcaactgcttcattttactgagaaacttttaagtaggtgcattagtatcttcatcaacaatagcttggtgataacaaaaatccaaactaaatacagcctaaggcagcttcaggaccctagaagtttagggctcttgaatgaagtagccttatagactaaagagccaacgaagcgaagctgcaatgacatgaaataataaaatgcaacttaaaattttatatgataatttccttccataagttgtaagaaaaataaatgttgtacacctttggaaatttggaatctatatgatccactacatggaatagtttatgaagcaagtaatgagtatttacttcttagagttagagcagtgccgacaatggaagcacaggatacccatactcagcgatgagacagccaacaattcttaccacaaccaaactaagatatattgactgcaatgttttctatgctgaatggttgttttgatcttagattcaaaccataggagcgcaggatacgctcagcaacgagacagccaacaaatgttacgatagccaaactaagatatattaactgcaatacaatttttttgttctgaattatgtgttgatcttaggttgaaacaacaggaccttgataaccatgttgtggtaaagacttcaaagttttgtacaaggctgaattttcaccaagtcttcagtagatagcactcacatatatcggtgcatgtgtgcaatttctttatcatacatgcacatagaaacacatacaggaacaaagaaatgaaagaatacaacaaaaacttcttctttttttttcctttttttgatgattgaatacaacatgcacatagaaacacatattggtgcccgtactatttatgtgataaagtcaccagaccaccagtcccaaacagagatcatactcatcaaagaaacaaaattgggaaggaggatgagaaataaagatgttgagatgctgacaataaccacattataaaacaacagcctaattcaagacaacaagcagaaaattgcatgacatgtttatgtcgaccggagctttatatttttggtcttttatttgatccagtgaaatgggttcttatatcaaccagtcgttgtgcttcagactatgtaaagtatatacagcaccaaggcaaagaatgtccatccttttattttaaataaattggcttcaaaagctccaatctattaagaacatggtctcaatcttcaggcactttttcttttttgcgtaaagatctacatgcactttaattgtgtttataggccactcagttcatctccagtgtttaaattatctgccttctctttagttttacctcactgctggtagaatggttccaattatacatctattctcttttttcaccgcattcgatatgcatagcataggagaaaataaataaataaataaaaaaatcgagcaacagattaaaaaccccactaccagagattgctaaagatcttgtggatttttgctttgttaaatcagttagagtgaggttggacggggagtagtatcaatggcagcatggatttatccgagactctgaaatgtgagagactgatcatgatcttcatttctgaagactgaccaccatcaaaaactataaagaagttgatacatacaaatgtaatttaaaggactaatgacaaaacttggatgagaatgctgaaagtaataagtaggcatcaacatgaaaagacggaaaaaatattgggcactctactcgtgtgaacatttgtctaactctttacaagtaagaggaggcaattttttgcatgtcggatggcataaaagccaagaccattagcacaactagcatgcctacaggaagcagtagtaacaaggaaggtggtggaggcaatggtggcaggataagcggaagaagtatcattgatgctgtgaggcagatcagtaccagaaatttttctgtgctgaaataactcgatggaaaggatttcccatgattcctctgcgattgagtcctcttatactccaagtttggtacactgcccaatgttgtcctctttactctgctttccattacaccactgcaattagacttaaaacaatgaaaccttttgaaaattgccactcagcatccaaaggccacaaagtgcatttaaattcccaacttggatatgtgaaggcttatcaatctttcaagaggtaagagatctgttcatcaagcttataaattcctctctgacgtgggactttaaggttcttgcaaacttgagtttgttctttgcctttctgtcgcttgcaatccaaatatatttattgaatcatgacccagtatccccaactggtgatgctgttttgtgacaaagctttgaccaactgcaacttaaccgcagacaagcaagcaaagtaggtcctcaaggaaactggtaatccactgctattgagaaggagatagccttcaactttcaaacttcaacctgttgataatgaatggaatatggatccccatcagtccaagaaaattgaagatctaattttcaacaacatattatgtggaaaaaaagatatatatcaaattgccatttttttgacaaggaggagggagagaccaaaaagtaaagaaaaaggaaaacacaaactgggctcttggagttggaagaaattaacatgcaggcagttctattggcatattcttttcctttatatacagatgatgggcagcctgaccaatcaaacccaaaaaaaaaacaaaaaaagaatggatggaaaaataaaaaattctatccttccctctcagcctttggcttttaagacctccccacatgatcaaaatgacacaaaagactcctaactttttgagcaaacataaaacatcgatgccttcctatatgatatgaattagagctttcttccaaagccccttcagattcagacccaactgattctgtaaaaatgctctagagatccattacagtaagagaaacaacaaagaactaagcattacctcagttggatttgctcctgtcaccactggaaaagggacctcctttgcattgcgcagcaagtatttttttccttcaagccaaaatcccaaacattaaagaagaatgacatgtgagatcagcacatgtgatacctggagctccttttattttattctattagagaagtaggagggcaaagaataaggaagaaagaggggtggagaggagaagggtggtagagatgttgtttaatggggaggcgcaattgataaatgtaatgcctcactcgggcaagaatcggagataacaggacttacgaggctgatatggttggggttggctgattagctctttatttatttgggctgtgtgctgagttggtgtgtgcgttagagaaggacagatgcactgtattctatacccaagtgggggcagtgatggggatttccttttctttgttaggaggcaaacttgatattttcaatgttttaaggttcttctcccctggcctccttcagtgactccccaattatattttttctcctttgcccctcaccagggtcaagttctagtaaaaaggatccgggttggttttttttggcaatatcttcaggtctgatcaatgacccatcaagcctgctcttattgatttccttgtaccaacataataatgataataaaataatagtagcagtagtagtaatataagaaataccgggtcccaacagtgaatcattccaaaatgattcttcttggaatttatagtcacaactgaagttgtgggagcttctatattctactgttggcatttggcaatattaatttctccctcatggattgatccatgtaaaatgggatttggtggatgaacatgttcttgaatgctagattagtgcttcattattgcatttgaatgctcgaatttcctcatgttttatttaagatgtcgttaaatccttcggggatctaaatatgagagatggtatactttgcatacaaatgtttattggttttcatcacggacacgtgatcaacacaaatatcgtgccgacacaacacatggactcataggattcacatgatccagagcacatgtaaataatagacacccaaatgcttgtgtaggttcaatgtccccatatggatgccataaagttttctatatatggtgtaacataagacatcacacttaattttcctcttttcctttctggtcaaaattcttttttttttttgtcaaacacgcgtcactattgcgactcgctcctagtttttgacccgtacaaggaaactgatatgatacattgcatcaactcatacaagggagctcatgtgatacattgcatcaatcgatagctactcatgaccatgatatttaaataaaacaattctagaaattctttaaataatatagatcttggtattttgctaaaataaaggttttatagagatgattcaaacaactattgtaatatgatatggtgatatggatgataactcggatgatatatctcaattttgcgtaatctttttttttttttatttggaagctggaaggtgcgggcaagttgcgaggaagggaactgcaatcttttatacagcgtatggagtcacatagggtgggccgacgaccggattcagagttttcggccagcggatgcaattggatacgcgcaaccatgagatcacgctttcatagtatcctcttgtacggtccactgaatgttcgttcccgctcgccttttggcgtggggccaaattgtcttgccggcaccagccttggtgggctccaaaaacttggattgctcttccacaagtaaagagaagccatctctctctatctctatcgtccttgcgtgagaaatattttgtacatcacgaatggtgcaataaaaatgatataaaatatattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatcgaattttttacaccgtctatggtacagaaaaaattttcgttcaacttattattggtcggattatgttctttatttaataaacttatcagcttcatgtttaaacttatttaataaataggttggtttgatctattttgtatcagaaccgaaccgtatctactccaacctgacgtgattagtacccaatctgagagagattcatggttcatccggtgcaaagcagggccaagagttgtacccgattaaaaaaaaaaaaaatgtgcaggaccaagaaagtctagggtcatggcacgaaaggcaaccaagcaacggtgcacctaccagaacagcgcactggcaacgagagaggccctaccctaagggtccgttagatttgaaaaatagatcccatattagattagtatatttgatataaaaattaaaataaagagatgataaaaaaattgatagatctaatatttatttttttaaaaaataaaataaatattataaaaaattgatatttaataaatttttaaataataataatttatattaattttttttttaataaaactgtatatgtaatcattaaatttatttgatattttttcaaattcattcaataaaaaattttgattaaaaaattaagataaatatgatattatataaggagctatgtgattataattattgtataaaaattaattaaagatgataatattatctcaatattaaaaaattattttatgttaaaaaatatatttataaatttaatcatattcttatataggtttatctctaattaaatatagtatttttttttaatattattttttaaaatattttttttaccaatcaaatatagtattttttttttctacaatcatttttgtagataaataattattaaaaattatcaattttatttcgtaatctgatatatcccagcagagagaatgatttcctggagcctccctctctaaactatgttgtaactgagttgcaattgtttccggagcagaagaagttgccgacttaaattattctcctaaaacatgaccaatatctaacatccgaacgctggaaataagagacggcgtgattaatgccatcccatatacggtctgtgccgtggcatcctgttctaatgcacacggagaagatagctcgaaggttttgaagcctaggagagaagacaggaatttaacactaacatgaaagattttaggaatgaatttgcaaaaaccgtttcttatttcatggatttttttcttctaaaatcttacgactcctacttcatggcttacatgcttatagctatcgttttgaatatataataaataaataaataaataaataatttttatatataataaatataaatattaattttttaatttttgaatttaaaaatattttaaaacgtctaaattagtcaacttttatctaatatccaactgtttagcaccattaaattattccaaaatgttggaattgtgactatgacgtaccaaactaaattcgaattcgaatctaattttattctgaagtcccgcatctaattggattctatttttaagtatatacatgttaaaatagaaaaaattatctatagattcctggatggatccgaaattatttttaagtctctaaattttttaaattaaataaaaaatctctaaaatattagcaagttatttttaaattcctgtcgtctacgtagattgattacataggtctatgtttaggttacacgaatttatgctcaagttacacagatttatgttcaagttacacaagttgcttatttttaatatctgattatatatgtatcttagttatacagaaataatttttaatatttaaaaaatttatttaatttaaaaatttaaaatttaaaataattttaaattcatctaaaaaattataaataattttttcttaaaaatattaaatatttggtttttttttttnttttttttttttttttgttcctccccgtaattcgcttagaaataggcccaaccttgcctaatgttggttagcacactattgctagattctagcagcgggcattatttatttatttatttataattaaatagttgcgggatctcaggtggcgcaagtaattcaaaattcaaccctcctttggttgcccgtcgtcagtcgtatccactgctcccttctatttttcctcgatcctttcctatttttcttgtgttcgccagaagagagctcgcgagagatctctcgaggcctcgtccacttctcatttggagctcggtacgatcttcgattggtttctgtacatatttccctcttttgattcattcctttcctctggaaaattcttttttccccttcttcttcccaatttttcaggaaaatatagatcggagatcggaaatcgggcggcattggtaagggtatgttttgctttcttctcgttttagtacttaaaatcgccgatttgatttttttagtagtttttttttttgtttgcattaccgtttgatctgttcttttatctcggggccttctgtagttgattcttcttcgattataattattattattattgtcatttaatggtgttgaaataagagggcagttgctggtcaggtgacagacagagagagggctttagggttggttgtgattggagttttgtaatgccgagagcagggattaatttggcatgaacagtaattgtatttatggcatcaactcattcatgatccaagtagtttgatttagttggaaatatttttaggggactatgggcatggtaacactccattggatgcaagggatggcgatggggctagctgcaagatgcgtgtccttgtaagagttgatctggtgcttgtgcctattctttaaaaagagaaaaggaaaagtagatgaaaaaaaaagaaacatggatgaaaattgtaatgctgtatataaatctcttgttcacatcatcttcaaatcatgttttttattcttccttgtaataaatgaaataaatacagaatccgaccctgcatcatggctcagttagaggatgctgccatctggaattactgcattactcaaaacaacaactatgcccccagaaatgatgtatccatgctcctctctgttacattcttggaccccatctgtgttaacaatctgcaatcatcaaaaaaaaaaaaaaaccaataaatcagagagacacaatgagatgtattgccatttatagcaaccatttatgtaacttttgccattttctcgtgactagctctgagttttgtgcttctattgtcaattaaatatgtccatgcatttattttggcattttttgtgtgaacagtctagttttaatatgctatcgatcgaactgtaactatgtatttgctaccttctaaaattctactttttttttttaattttcagataatgtttgttcatccataaagtgagaacaccattttgtaataattatgaagttaagacaacgagtaagataatttctattaagtacaacagatgagttaaaaatgttgccactaaactttggtctatgtcaatgttaactgcaacaagcttcacctggaagttacaagaaataatgtgaatatgatcaaattgattagtgcaacatggagaatactaagaacttgaataatatgcattgtataatttttcaaatatttcagtaccctgacatttcttcctatccttgcattcttatcaactatagcctttcgaatatgagtctgttctccaatcccaactgggacattgaagccttgcaattttgtccagttctgttgcacctctgtctatttgatgacaaaaggaaaacttagaaagagaaagcaagagcatgtgaagatggttgaagtctagtaaacatcattaatatcagacaacaattctctacatttcacatttgtctatataagctgaaggacatgattaactggtaaagttaccaaactataggtgtgtattgataaaaactgcaaaaccattccacactaggtggagctttaaaagtgcatggtataaaagccctatttgaagcatcccaggtgtaatcaatatgacacaatatatgttgggcatcagcatagataatggataaatgcaaatacaactcatggaatatagtttcaagagtggtcatgtgctggaccaaagcaatcatgtttcttgtatacatcacaagaaataaaaaagaaataagaaatgatttgtgaatgcttcatacttggtaataatcactacccatgatcacagaatcctcaatcactgcttcttctccgatatatgttcgcataccaatcacggaatcagtgatctcgcacctctactcttaatataaagaatagaaacagagcctacttagcatcgaatagatggatgaatatgaaattatggtacttagtcaacattcaattatcatagatgatgtaatggaaaatttataaagacagagcatgattgtaatttattttaaaaatatcagattgcttagacaatgcatgaatatgtaccaattatccatgatgtggatggctacttaaactcaagcagaggtctgaaactttttagcattatgacaatttcatttaataaaatcatactgctaggattttgcatcacgataaaatacctgcattgtgtattgctatttaagcagtgcagaactaggatagaaagatcatatcgtgctacctgactgtcatcaagtaacttcaccccccttgaccactttatacctggatgcttggtcagccaaccagctcagctgcctccatctcctctgcagtcttttttctttctagtgtcaaggccaggcatacagatttcattgcaaaatcgtttttactgtagactaaaattctattcattatcttagctctcctgtgtttcttgatgctctttaggtcctctaataactatttcagaaaaaagaaagaaaaacatatccagtctttgttccaatttatttttttgtaaaaatgttctttcttctttccttgccaaattttctcattctagttaaagaaagtggttcaaatttcgcaaaagctaacccattttcagacatccatcaatctgacttttgtaactcatcaggcagaacaagctagattattatttgttacgagtaaaatctgcttcttttgtaggcctctaaagttaaagcggccacaagacaaaaagcttcttttctttctttatctaattcccccaccatgtcacgcagattatgagacaaatcaggtttacttttggggtattatcttcaattaacttcacctttagctttggtaacatatttgtaggtattgtgcagatgatattttggtctatgattgatggatttacataccaatgtatatagaagaccatctcttacctaagggacatgcattatgtcaaccctctgttaaattatatgtcttcaatgacatacatctatgcatgcttactggagaacatgtcaattgcatgtagcacaatgttatatatttcaaatttgagtatgtcatttatgtaatcataccagttattttatcttcttctttctttttacatgggacataaaataaatcagaaaatgaattaagtgcattctatgtatataatatccgtaaacgcatgtcatgttggttcaaaattttaaatgatgatagtatcaagttacctacatgtagaatgcaaccatcaccaataatgctctcccttatgagagcattggtaagtacagtaggtggtaggcaatgtggcatggtgtagataggagagtttctgtcatggaaactacagcaaaggcgtaggtgttatttggtagagagagagatatctaaatttgtcattgaatgtagacctaaatttgttactgaatgatgctgttcattcatctaagttgtgtactgacttgaagccatgagatgttctccttgcactttcaatgttggcacggtagaaggcttcaatggtttcaacgtcttcccattgtccatcaaacatataagcatgaacctgatacaagagaaacttagaataatggtactactggccctcttgacatagtcaataaaagggaaaaacaaaaaaagaataatgctataggaccacatgaataataaaaaaattggaatgttttcctataaaagtaaagagggagagaaatctggataggaaattcagctgcagataaacaaataatattctgaccttcattcccatggaaattgcacgttgtataacttcacttctgaaatcattggccttaggtaggagcttttctaagagtttgatcatgatgtctctcttgatgacatagattcccatgcttctgccaccacaaacttcttcttttgtagaatttcctatctgaattccatgcataatgatccaaatgatgtaacttgtaggaactagactgtcagctttgtctacttgttattaaagaaaaattcagaatggttccaatctagctccatgcatgcagttctaaagctgaagaattatttctttttaataggatgtggataacaaaaaaaggattcattgtacttcttgtccgtaaattataactagagtgatcttaagtttgcctctttttatgaaagtaagaatggaaaacttactgctgcataattatctcgatccctatctggtgcatgtttgacttcagaaaatttatttctgtgattctgtattaagaaatcataactgggattattgttccttctgttacatgaaacagcaactgtgatatctgctccgctatctctatgtcctttaataagttttgcatagtccatttcataaatatggtgactggaaagaaccagaaactcctccactggatgatcttttattacccacaaccatctcctaacagcatctgcatttccctaaaacgccatacatccatttcagtaatttttaagaacatagaaaagtcatagaagtatatgaaaaatgataataaaaacttctttttccattgagtatgggtgtaactactacactgcaaaaaacaattcaactctagatgttattattatttcctaagcacttttagatgcaagctgagattaaaaggagctgtccaagagttattttaaaaaattgtctcggcaaagacatagggacatggtcttgttcaagaatattactatacagatattgaaacataaaagggatgttggtatcttgctattccttggtacaaattgtaaacttttcatgaattagatatgaaaattgtgcctaaactgctgtataagaatcacgctgctagtgctcaaaatttggcaaagacattctgaagtgctttgtgaaaatagagagatttgaaatggaagtacaaatttcaacaagatattccgtgttatgaaaaggaacgatgatttgatgcatcagtttgaatcaaagatttttgaaatcctagtacctcagtagcttgaatagcagcagctggtattgcagcagattgagttcttggaaattgtaagaaatcatgatacagggatctcgaaaatgataaaaattgtaagatggtgcaactttattgaatcatgtaggtcttgagagatgatatttacaattatggttcttattagcaaattacaactattgacatgcaaaatcacaagtgccagataaaattttacagatttttaggggaataagtcaatcttactgctttaaaatagaaggggaaaaagagaagtattgagcctgatgatggtacagaccttaaaccaaccttgctcttcagggctttggtatgctgtcaaaatttctacaaaaccatcctttccgagcccaatgttagaataggctcttgacagatgagaatttagggaggtggagttgaactgagttagagcatatatcctgataatgttactgttgatgcagttgctcaccacaatgtcaatcagcctgtagtttgctgctattggaatggccccttttgatattctctttgtcaggggatacaactttgtctccgagccatcatcaaggatgattgccagaacactctgtaaccaaatttcttatagaagtagctcatatttcaacatgtgaaagagtgttagctgcatattgtaagatgaatgggattgtgaaacaaattatgtatccttaattttgttccaattactttatggaaggattgttgatatcggtcaacctctaactatgtgcattttctttactcctatggttaaagtccttgctgttgacatgtaaataaatgctgactgctttgtatgttgactgaactatatttagtatatttcaagtgtccgaaaatatttgatgcaaaactcaaaccctgttccatattgtgtcttaattcaactgaaacatatgcttggaattccagttcatcaaacttttggacaccagtggttataactttacaattcatcatccttgacctttttcaataattaaattaataattgtaaccagcagttttatctaatatgtttgaggtcaacacagagttcataatttgcattatttgcgaatgttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccgcgaaaaaaaaaaaggaggacaaaacaaaaatgattcaaatttaacctaatcatatctgataattccagttatgagacagcagtgaagaagctaattgagtggctgaccaaagaacccaatatttagaaagcagagatagaacagagaatacaggtacgtgcctgacttagtggtggattcaatggcatttctttctgagagtggtatgagttggaaatgttaagaccatggaaagtgcgtggctgcttcagtgatgttctaaggaagttaagttctgatgggcgaatggggagtgttctagcaggagatatcaaaggagaggaaagagctacatgcagcaacaccatggcaaactagttggtgaggacaatatgattcactctgcgttcttctttgatttatcccgcactgtgcggtgcaatgcttcaagctagaaaaggtgccagagaatatgttgctttccttcttcttcatcaacaccgtttggactgcaccacctttacgattattaacgtaccaaaacaaaatcttaccaaaagaaaaacataccaaaaaaagcatcacggttggtttctctctctccagtgtaggccaaccttgcagtgagaagcacgtgatgtttcacagagaaggggaaaagagggtgtttattcttctctctcagccctagcttctttcattagtccaagaataaaggaaaaaaaaaaaaaattgtgccaactttatggggaaaagcgaccatggtaatgatgtgctcaactgcaaagaggatgaccactctttgacatgacgttgcggcggtcagaatggggtgttcaccaagttaagcatgtctttgtaggctctcaaaggttacagctttaacaatatctcaatattaattaatcctctctctctctctctctccattttcgttttttcctacgcctgtcctttagaagcatctttaaggatgcaggctacgcaaagaacagatcctatcaagaaagaaaagtactttgtgcaccacgggtggtgcagctccatgcatactgtccgtggtgattgactcccacacacagggttgacgaaaaaaattaatttttacattgcgtccggtcctgtgcataaactaatcactgtaggcagtgcacgtgagctgcaccgtctgcagtgcagaaagtatttctcatcaacaaatgaaaagaatgaatgggacctcctgtgaggtccaacctcatgattagctggcccggcccattggccggacctggtgtgaagaaaaaagcccaaaggcctgcttccattatggaatcaggatagagccccatggaggaggaggtagattttgcctcctcaaactccaaccaatagaaggattttgcttgctataaatgatcctaatggccactcgagaaggggtagagccccatggaggaggggggtggattttgcctcctcaaactccaaccaatagaaggattttgcctgctataaatgatcctgatggccactcgaaaagcatttatcccaagcccacccctctctctccatcgtctcctctctctcttttttgccggtgctctatacttgggcttatcatgccattaccaaagccccatcagaggtaaggcatcgttgccccccccccccactttgttgacaccctgtctacccttgttcctacctcatgtaatcatcatgatcgagatcttaccatgaattgttggaatcatgttaggaaaaatgaccctatttgatcacctgttttagatctaattattagcctatttcaccttttttttcgatcattttctttataggcaatcgatgccctcggccttccccctagatcggtcctcggcctgagtcagggccctagctattgctaagcaagctaggagttgagaacgatcaagcaaagggccgtcattcaaccctatttttggcaatttttggtccttcggccattgaccatcaccctcctatttcccctatttttccaagaataagaagaaggaaaaaaaataaaataaaaataaatatagtttctctttctttgttattctctcactctaatttttggatggaccaaagagtcccacccttacgatttgggttaatcctgatgaaggggtcctgaccatgactgttgggcaatgcactaacctccatcttgaccttcatcggatcctaccatatttggcaatcctcgatagtgatgactgacttgtttcttaatttgatctttgataaaaagattattcggattgattgattgattcgaaccattgagctttacaatttaattggcaaatgcctggtctatcttgattcgagtatgaagctgcccctaatcatacccctagcaagttatttcgatcacttagtccgattgtgcttttcaaaatttttttttatgtatttagcttctaaaatattgactataaaattaattatattttaataactttgaataggagtatctaatctactggattagagtgaaaatttgaagcgaggagagtaattaacctaacacttcataatatattttctaataattttttgaaaattataattagtttattgtatttgtttatgatctttgttttctatttgacaaaatagaaaatttaactggacagtttctaaaattatttttatctatatttatagcatggctatgatatggatctgccgatagggattatatgttagatttgtcgatttataatataagaaattaattttgatatcgaatcaccaatggttaaaataatgatatttgttatctgatatttcgtacactctatatctattatctgaactatgtcactgaattatatggccatagtctgatgttgcaattaatatttatttttaaatatttatttttgaaaaataaaaaaatattattctttaagtcttgatatgtccggccaatgacacaatataaattatgtttgattatcatctgctagcatacttagatgtgttatgttgctcattggactggtgtaactattattttttttcattttttagatcttgaattataacttcctcggtacttagggagcatactagattatttagagcaattagtggatctagttgtcctggtcatttatgtcaattattcttctttttggtttagcttagatttaaagaattttatcagaattaaatattagtaatattttagaatttaatgactcagattatcttaaattattcattgatgagaataattgattgaatttttattaaattaactttcaaggattaaagacttttattattgctctaaaattattgttatttaatcagtagccttgtatgcttgtttcgtctaccttgcaggtacgtggcatttgttatgctttgggtttgaagcgtgatagctatgatattggttcaaagcttaggcaattattgcatgtactgcaggctcaaaacattgagggcctataaaagccctaaaataaggtatggcaacattgatctaactaagccctgttcggccaaggttggttcaggggtttacaattttgaccgggttggagtagatttttattaacccaagaaataaatggatcggttgttttggagcttgcttggataaaggttagtgttgctttctgatgttttctccctaaaaaacttttcttcccctaccttcgtttggtagaatttaaaattattgagttttttataagcttaatcatgccaatttttttttttggaggttttagtttttatcttaaacttcaatttattgtaattaggttatctaaacattgcaattattttcctagatgttacttccatctgacgctgtcatttgacaagtaatgaattatgagaaaaggttgttctaaactcattctcttcttttccctctcttcaagctaaggtttttacttcccatctttctccatttccctccttctttttcggtgactagagatccatgacagacatcactcacaaacttctaaattagaatgaaaataaaatagtctataacttcttgatgttaaattttcaaaactgtccctcttcttgttagctcatgcatgatgcatgaattttgccccatctctcctttgctgaagaaacaacctattggacttttaacaggcctagacgaattctactgttaatgttgagaaagttgcctttccttgtgttttgctgctagaaactttaaaaatgctaaagcatccatgtataggctctgtttaggtaatcttgttttccatataaataggggtgtgtactaaatcagaacaggttttcctcaaaaatttattcattagtttggtatggacaatatataaagatgactaggatgggtttctgatcatttaccctcttcccagtcttcatatgttaaatatgtggcttagttggtgattcgagcaaaatcaaagattgaaaaaatcttctagattaattggtgttttgagttctattatgatacatgaagaccattaacaaagactttgcagcatcgtcggtctctaatcatcagattggaaggaagaaaatagaaagcaaaaatactggtcgaaagaggcaaaaaaaaggggagaagtttaagacaatcttttctacatcaactagttacatgctacattagcgtctatcatatatcgtatgatgatatgtgatcatttctgtcatgactgtcgaatagaaatatttttagttatatggtttgattataattaattgaaatttagaataaacataaaaatcctaaaaagtttagagtttttggcgtaattaagtctttttttgtgcttatattttacatgttggattctagcatctactaagagtattttggggtgtctagaaaatatagaaaaaagaagaagaaatccaaggtcaaagaaaaattctagtcaaatctggaaaatcttattctgttttattttaatttttctaccatccaaatgacccatctccttccaccaaaaagagggattagcctaatagtaatagccgtaggtagcatttagtgatctaaatggatcattacagtaatctaaaattatcgatgatataaattccgatggtgatctaatctccaatgatctaaaatcattatatttgataggctataatttagtaattaaagatctccagatatctataagtactctatttggtatttcataaaaattcaaaatcattgaccatataatatcaaaactatccatgatatactctataaaaatatatttatcaatcatataaaatatattatagtaatatattaaatatatttattaatatattaataattaatatagtctataaaaatatatttattagtcttataaattattaatcccataaaaatatattgattgttatcatagaattaatatttttatttataaatacaaatatttattttcattaaaaactaaggcaaataaaagtaacatattaaatactttattatataaaaattaggtacaataagatatttctattttaatttaaaattatcattaaattataatatgacaataatatgactaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttggaacacaacatatacgagttttagttatctttttagattttaatcttcacttggctgggtcaaacagttcaaccacactggatgtagcaaatcgagcagctttctccgaaatttcaaattactatgcactaacccaaataattagaaaactggtcttaatttgtttaacaaatatttttaacacctttcccagtaaatcaagccaaccctaaatggaggatagcaaggtacaccaaattagatttaccaaaaaaaaaaaaatgatacaccaaattagagttggtgtggctcaagacaaattggccttttttttttgttataaatataagacaggccggattacaattaggcaagatcccaaagcagggcaagaatgagtcgggtcaaagcaggtcaggtttgacgaactgacctcggatttgggtccaggggtcttcgaaactcgggctgggtgagctcgcgaatcggtcatgttcacattgcccatcccaattcccaaacgaggtagcaggtaagaaagattgaaagagcgaccacccactacgtccgggagacgagagtggcagtggagagacgggctgaggtatttaagccatcatcccctccctgcatggctccccacagtccccatagcttcggccctcgttgtcctccgacaacgttatgttggcccagatgctgacagcaagtcccgcatcgggcttcatctgcggctgcaaacatagcggggcatgcagtcgaagtgtttgatgatatgtttcagaaggtagcttatttttttttagcaacataatttggtatgcttgctgttttctctcattatttatttatttatgttttcaaaatcatgaaaactcgaatattttcagtttccaatgagtaagaaattatctttcaaaaaaaaaaaatcataattcatgtacctcgattttttgaataaatgaggatgaagattgccatatgttgccgttttcaaacttaatgcgttgcttacggcttttgatgcattttatccaacattgtcatcttcccacacactgatcttatagaaggactcacccaaatctcggcttaaagctaccatactttgaattggatttcttgtaagagtccttcatcttattaataaaacttatgcatactcgagtagcatactcgagtagcaaaggaaggaaaataagaaaccccaataaggagtcaacttctataatgcaatggtaggctccatgctgtggtagaagttttgatagaaggattttttgtgagagaagagaattcaagagaacaggacaataagattgcttcatgcaaacatctcctactgcaatacttccacaatcatctacttttatcctttattatttcgttcttatcaatttttagctttagttacatgcatttatacatgagtttttactacttcactcaaaacatacttcaatttattgtaggtttggatcaaatattgtcattaccatcatctaacaaagagatgccacaacaccatcaccacaaccccacaccagcccaactctaacctccactccctctacttccacttcctccattcctccccatccctccaccacctctgccacctccatgcccgcctcctccgcactggcctctacaccgacgccatcctctccaccaaactcctcctcacctactcccagcgctattgcctcctccccaccgccctctccatcttcctccatatgccttgccgcacatcctactcctggaacatcctgatcactgagcttgccaggtttggccttccccataaatccatggacttcttccttaggatgcagtcttctagcataccggttgatgaatttacccttccaccagtcctccggtcttgtgcccttttgggctcctctcctgccagcatgtctgtccatgccctggcagtgaagttgggtctagaccataatctttatgttggctcggcgctggtcctttgctacaatggtttgtctgaaatctctctggcacgaaagctgtttgatgaaatgcctgaaagagatgcagccctgtggacatcgatgctgtcagtctatgcccagagtggagagccagagttggctttggggttcttcagggagatggtgagtgagggaattcagttagatggagtggtcatggtcagcttgctattggcttgtgggcaactagggtggctaaggcatgggaggagcgtgcatgggtgtagcattcgtaggttcttggggctccctttgagtttagggaatgctctcatagacatgtatgttaaatgtggtgcatttggctatgctgagacggtgtttagtatgatgccagctacagatgtgatttcatggagtgctttgattttgggtcatgggttgaatgggcatgctagtgctgctctaaagctttttgacgagatgagtgaggaagggatggagccaaactctgttacctttctcggtgtgttgtcggcatgtgcgcatgcaggcatggtggaaaaggcctgggctttctttgataggatgaagcaatgtgggattgagcctgaattgaaacactatgcttgcatggctgatgcattgggaagagcagggcaattggtggaggctgagatgttcatcgaggcgatgcctatggtgcctgatgaggctgtactgggagccttattggcaggttgccgaatgcatggcaatgtggagatgggggaaagagtttcaaggagattaatggggatgagtccaagtaagagcggttactacatgagtttagcaaacatgtatgtggatgctggtagatttgtcgatgcagagatagtgagggagttcatgaagcagaagaatgtgggcaagctgcctgggtgtagcttaattgaattggattttccatcattgtcaacattagagtagactgtttatatgtgatacaatcacatttctacctatcttcttaatgaactcatgtgcgtgcatggaattttggatatctgcttggtggtgatacctagaatatgaatgaagggatacaggaagttaactctggtgttgggatcttgagggacactgttaaagattggtcaaggcagcatgatgtaaacaaagcaagatgaatgaaaataactgatgtcaacacccagcaagcagagcgagcggttaagaacacaagcatgtagtacaaggtatccatcatgagccattatgtgtgatatagatggtaagttgggactgttaagaagttgaaatgggtatatgcattgaaaatctatgtaagttaatggaaaagatattctaatgggtcttgggcctgatagaatatttaagtgtctctgaccaagaacattatttatgatccggagcaattaaaagagacggatggcgacttacttgaatctaaactttacagatattaggagggtagccctttgggtgtcaaactggaatttttagtgggcaggacctctttaatcatgagatgcttttctctggattgtgcattggatgtggatcaagcttgggaagtatgtgaattctttctgttaaagttttagtcaactgtgatgagtaggtggaagctttactccaccttgatgatggattgtcaactagatgatgtttaaagcatcagaagtctaaatggattgccgtattgctgcagaactgctacagccatcttcttggaaacaagttaacaagccatgaaaatttttggaagtccattgaatttgccctaccattttcctttaactccaaataatcatgagattgattccttgtgactttctgcaagccaattaatttgcacaaatcattttgttcatatactgaataacaattaatctttaggttattctaaatatagttcaaattaaatatctgcagttgcctgtatgatcatataaagcaaattcctgatatgcttgtcgtccgtttaaaatagagcttcaactctatttcacgtcatctgacatggaaatgatataagcacaatatctagagagagaaaaaaaaaagaatcaattgcattttgcaatagctttttatatgcttgtttagcaccctccatccaatcatttccacaaaatgagcagacatcatttgctggtatttctttccagatgacaatgttaggtaaagcatcatcaagccatgaattcagccaagatcatgcttgtcacaaaatcactttctgacatttaccatcatcttttttttttttattccagtttgagattaatataaaactctaggtcagcattgcattccatgtggccatacatggtgatcaactacaaaacaaacaagcataaacatggtaaaagagagaatatgatatgaaaagagagaatgacgtacaatcaaggttaataaatcaaaacataaatcgagtctcccaaaaactgccataattttttaatggtcaagttaacatcaaaaagcaagacgatgaaattgcatcatgcaaataaatacaagaggggaaaaattacaaggaaatcaaatgcacaataaaaccagtgaaaagatcatagaaaactggagaagaatttagataaccactccttgcgcgattctgaactacggactagaaagatctttccctcgatctcattctttaataagtattcaagggctgttaccgacagtcgctcattgtaatcgcatgcttttattgcttcccatatttcctcactataatttctaggttttaatgtctttatcgcatcgatcaactctcctatcttcataaccaagctctggatgtcaacatctgcaacctcttgcctcttggtcctggaggatgtggccctcctacatgagtcaagtgagggattgggagatgcagcagctggagaaatggctggctcttgctgacagtgacctctaacctgattgcttgaagactttgcaacctgttcaatatcaactagcccctgcatattcttctgatgttgccccttaatttctctatcaatagatccaatatattgatttttatcttcagtgaactttccgttggcttgatcatcaccacaaatgatagctagctcatcatagttatctataggattattcagcaaacaagcatccctaggatgagcctgcaaagcaacatattaaaaaaagaatcaaaataaactagctgtcctgataatagaagtgtagcactctaatagcaaagattgttgcttacacgcacatgatcttggtaagcactggttcccaaactaatcatcctggcaacaggatcccaactggctccacttagacatttcagcctttgtattttgttccaccgggtcttcagagttttcaatcttttttctacatcagtttcatcacattttattttaaatttttgagatacagcttctgcagcagctactagagcatttctcttaaatgacatgtccactttcatgccaactgccacctgatcgactaagaatcttagaagaaacttggacatttccgatttccatttaaattttttgcaagtttgttgacttccactacttggggaagtttgctggtcgcaagctgtttgtgatgcatcgagttcttccattatattctgctacgaaaacagtaccatttgctataagttatttagaaagttaactaacacaatcattccattaataaaaaataaaatcccaactacaactgaaattattcagtaaaatcaaaaggatagatattaaaaactcatatccaacaaataaaaaataatagaaacgagaagcatgattaatctgtcaaatctcaattatgcaaattctcaaaataaacaagttctcatctccatgttctctcaacaatctaatgagcagttgatcccataactaatgtgattttcctctcacagctctcatgacataatctcttggtggcaccgccattatcagaatatgcaactgataacatgctgaaattatagcaactcaggtccaataagggaaaagaagcaagcattctaagatttcaaatgtggtttcaacatctcaaacaaaaacacaatgataattaatggagtgcccataaattggatatttcttttgcattcccagcctgattttcttgggtggaattttcaagtggtaatgtagaccaacaggacgtgaagaaatgaaccaacggttcattatgcatcacatatcaatcaagaagcaagttcatatcaatcaagaagcagttcttcagtggtggtgttgatttatcagtacctatcctccaacctccttatccataaacagttcgataattatcactcttcattcgtattatgcttaatttctacttgatccctttattaaatgaagagaactttcaagtcctattgtgtgcttaaacacaggttagtttcttgccctagatccaacttggatttcctcttccataaacccctaagctcaatttgctccgcatgcatttccacttctctcacatgacccatcagatacactcagtgtcatgttgcaatctaagtcttcgcatgcatcgtgaacatcctatagccttttaagtgtatctgtaagtgaatgtgagaagaaaatggaggggttaaacatgtaatgtgaaaaactagtttagaaaccatcgaccagaatctaaaatttcagagacatgtaatctaaatatatctgcagaatcttcccaaccactttttcacgaagacatttcaccttaaatctagattgtgtttagatgcccaatagctaaccacctcttgaataactttatctattggtacttgccccataacaaactatccagagaacaattttattcactgtttagttggtactcccataattagtggaataaaattgtgaaaaaagtgaaaaagtaaataaagatatgtgttcccctgaaataattttaacctggttaagtatctttttcgcacattgacggaataagtttatttatcactttctgagcagcgttttgactggttagcaggataacttcatatgacccaccatttaaccagcatccaagcagcggctaaaagtcatgagtttgatttggtgcggcatttcagcaaacaaattatgttcctaaactccctacccaaaaaattaagccgaaacaccgcattggaaattaaaaccgcaggaacaaaagcctcaccactccaaggtgcagcctttcagctcccgacaatgattctgccaagttcggggccgccatcgcacttaggcacctcggtcggccgttcgtagcacagcccacggtggcggaaggagctggatggatcgcaacaaaaaaaaattgggggaaaagaacagtggaaaactaacataaatcgggagataaagagctaaggagggcgaaagcgcacctcgagtggaagaagagaacgagatgagggaactctcgggagaatggcagcagagaaaaagagtagatcgagggttccttggtgccggcgaaggcaatggaatgagatggccgagctgggttgctgcaaataaggccatgcttcttcgttccgtctctccctccgatgaccgcttatattggcagtcgggagggcaactgatcgtggccaagcataccgttgaagagagggagggcgctggattttaaattagaaggctttacattatacccccgcaagaagttggtcttcttcgttaagcccttaaggattagctgtatagactcaaactcaaacatgatactgcttggttccagtgttgaatattattatatcatctaacatttagcacatggaatgtgcttgtctgtatgtgtaaaagagaataaaaatgagtttaggttattaataggccctaggcctaaaaccaagttaggttctaaatcccaagcatgagtgggctagcctaaacctagcccaaggatatcaggcttgaatcaacttaattcaggtacgatgttgggctaggctagactcaaagcatgcctctatttaatttttaaaagatttttaatctacaactagcttgagatggaggagagaagggccctctggtgttggagtttctgtaatgttatgaaccattcatccattgaataaatagtagatgaaagagtgatgacaaaaatagagaagaccaacattgtttactcagtctatcccttttaatcatgcattgatgtggtgccatcatgctattgcataaaacatgcatcttttgcatatgcatatatctacaaaagcttcattgccatgcctcataaaattttcaacatcacatctttaccatatatttctccaatgcgatgaaacgcttggagcttagagctttgtccttggtccactttgaccaggatttgattagcggtatttgactgtggaagacaaccaccaaatttattattaaccgttaaccaattacagcaagagaaggtttggatcatgcattggaagggatttatcctgaaggtgggttttataattttgatgtatctggggcctatgctagataccaatattgctgttgtctattttaacctttcagaatatatcagaaattgttttttttgagattttgccatgatacttcaaaatctcttttagtcattttactattgactttttctagccatctattttaaaaaaagatggcactgatctatttattagcaatcagctttatgtatggccgttgtgataaataacttaaattttaagtgcactccaaaaaccaaacagctggcgggatattttgaaagtagtgctccatttttttcctccttcctcttctcttcttcctccgtcgtgataagccaccatcccttcccatgcggagtcaaggtatggttgaggggaggcgagtgacagaagtcgagtgtcgaaggaggagaagaaaggggatggtgggctcaagccgcaaaagaggcaaaaagatgagaaaagcgagcggcgaaggaggaagaggaagagggatggcatgtggctacgagaagatgagcgacagagatggagaaggggacggcaagcccgagcaatagaggtgaaggaagggggtggaggggaggcgagtgacggaggaggagaaggaagggggtggtgggcccaaaccgcagaagagaaaaaaaaatagagaagctagcggtgaaggaggaagaggaagaggggtggcatgtagctatgggaaggcgagcgacaggtggagaagggggtggcaagcctgagcgacagaggtgaaggaggaagggggcaactgatctaagcagcaaaaaagcaaagacagcgaaaatcgagcaatagtaagaagctacaaagaagaaaaaagaagaggattaaaaaataataaattttattttttaaaaataaaatataaaaaataattataatataatattttaaatattttttataataaaatattattaaagaagtgttgtagtaaacactatcatttaacatttgcaggaggtcaaatgctattcaaaatatttttagtgtttaaataaaattgcaattgctatcatgacagtgatgttatcacgaaaaataatggacaaaaatgggagaacaaccatctttctatccaaattattgtttatttaataattttttaacatgatataacgtaacggttcatctccgaaactgttatggtggccgttacttaaaccacattccttgacggagcctgacggccgtctttcaccaaggaatattcccccgccccagcatccctccagtcttccactattttcccagactccctgtactcctcccgcggaagccttgaatgtatttcctaagtttctactccccttgtcttcgtcgcgagagatggagcagagggaggatctgaattccatcctcccctttcttcccctaatcctccgctcctcctccctcttctggccctccaaagccctagaatctcttaaagccctagccctcggcccggacgtcagccacgtcgattccggagaggtcctcttcgacgccatcctcgatcttagggactccatcggcctctcctccgaacggctcgcctccagaaccgccgatggatacgccctcttcttcgacgaggtttctcccctctctcggtcaactcctctttttctgtgttttttttttcatttcattttttggtgctgggaatcgataatccgaagaaatattagatcgagcaatgtgctttctcgtgaattaaagattgagattcgattagttttagtgaaaaatatcaaaaagaggaaaatgatcacggtctgaattatggaaaagtttgtagtttgggagtaaatttaggagttgtttttcttttgtttgagcagctgatgtctagggtggattcaagggtgtggtttggagaggtcattccgggccttgcaaggttgttgctgcggttgccttctcttctggaaactcattaccggaatgccgatgaagtatttggtggacgaaaagctgggctgcgtataatggcccaacaagaagcaggaatcgtatttctaagtcaggtgagctttctcgttatgatcaatctatcaatgttttgcaagaacttaattgctttagatgtgtctagcccatttactcattgtgttcatgtgttttgtatcagttggtttgtttttcttgatggtttagtatgtcctctttgcttgaatttttacctgtctttttttttaaaaaaaaaattaacgttgtttggaattgtttaaaagttttatgggctcccattatgctgacacattttgttatttatttcaggaattgatagctgctctgcttgcatgcgcactgttttgcttgtttgccaccagtgaaaggagtgtcagatatcttccactcattaactttgatcgcttatttgcgtaggccatttctcaccaactcttgcagttgttgtttttctttggatgtttataatattatgcgaacatgctcgccagctagaaaggttctgacattatgcagttctttctctctctctctaaataaaaaataaaacatgctctatcttggttagaacttgcagaggcttgtgtatgtcgatttatgtaattaagaaagagtctgccgtgacagcctttcccactattagaaaatgaaaggaaatggtggttgatatttagctgattagttatgtttcctgaaacctgatttcattggcttatttcaggcttggtagtagagattgatgcaaggtagtcaaagacgaaaggtgcccttaagacgcccttaaggcgcttggggggtctagcaccttgaagcgaggggcgtcagaaaagcgctcgcctgagtgaagtaaggcactaaaattgaggaaaaaagcagaaagtatgatatataaataaataacaactagtgataactattgtaacatgaattaccatataataacaatttaagcataaaacatatatataaaacagtaaaatgctcaactagtttaagataaagtatatgataacaagccataggcagttctaaatttatgaatgaaacaaaaaacataacaagtcctaaaattcatcaatagaatcttataaataaaatagaaaacataaacagccctaaagtggaatcatataaatgaaataaaaaagataaacagccctaaagtctaaagttcattaatgaaatcatcagatttagtttcacttgcgaagttgtcatcactttcgtcttctcttccttcattggatttatatccttcaacatcttcttctgtcttatctgaatcagcctctatctcttcaaaactaactttatcatactaattgactactttatcccctgttagtaatggagctgagaagttaaatgggcggtcttttaggttttttacacttttcagtcattaaaaaaaaatcatagagttcattgaggcgttaaaggcaagtacctcgtctcactaagaaaggctctaaaaggtgctaaaggcatgcgcatgagtgaaagggcatcgcttgaagtatcaaggggtggtgaccccttctggcacctcacttgagcgtctgaggtgcgccttttggcacttttgacatcattggattgatggcatatatttttgcacatccatgctgatatggcataattgcttacattgtcaaaaaatagttgttattgtcaatgttatgagttactgaattgtattatgtgctaaaaggttgtatagctgagccttgagttgtttgctttctgtaactggcacttttttaagttgaaatttgcaaagcttgtggagacatggtaatctcattttggttattacatgatatgcctcatttattgttggcagattgacgaaacaatattttttgccaaagctataattgactccattatcacactttccagggcccttcattcccatgctaaacggagccaggaacagaaaataaagtgcattgttcactattttgagaggatatgcctgtgcatgcctatgggttctgtttcctttgaacggaaagtccttcctctgaaacaaagttgcgatggcatatcatatcctgaggctgctttttggaggaaatctactgtttctctttgcccgtttgaggtaaaattgaaaattgtatttcaaacaaatctaccaagaaattatgttatcattttccctgactttcttaaacaattaaatttagtctcctgagtgtgcaaaacaattggaaacagttttgaaggcaactgcaagttgaacaagtatttgtggaggtctcttgtaattctttgggaaattcctttttccatgggacacaattattttcagatgctccattcccctttttcctgcttgttagacttgagacacctgctttttgtttaggcatctacaccatgatcttgttgctcaaattttgtgaaataaaatgatttttccttcaaaaattgaccaccataatgatttccttttcttgtcaggtcttttcttctggcttgatcgaagaccaacaatatgaagctcttgaagtagattttgcaaatgaatttttgggaggaggtgctcttggcaggggctgtgtgcaggttttccttctgaactttttaaataggtagatgccactttgctctatctttatactcttttacaaaatgagggagatttgctattgcaaatttgttttaaccaatgaaaggcattcaaattctgctaaccaatttgattagtacatagattggaacaaatattcaagtgcaataatgcaaataaaacattgtttggtagaaatgaccgaacttcagtttttatgtttacttaagggtgttagtagtcttttattgattttaagctaacatggtagtcatcatttaaacttttcactgctgaataatatatccttatgtacccccaaaaaaggattaatgtatccttaagcaataaactttagtattcttacttattttttctttaaattaattttatgggctcgatcaagtgaagaaatagaattagagatttatatgtggacacgtatatttcattcttacattcttaagtactttcctagccatgtgctagttgcaaggtttatttgctctcacaagctttcaaacataattttggcataagaatgttacctattgttataagatcatccttgacttatattatacaagtcatactaatgacaaggcctagcaacatcccggccttgggccaattcattcgtagcttggtcttagactggaataattgttttttgcccatagttgtatcatgaacaatataaaaattccagtcaagcacgggttggcccatccttctattatgaggctcaagcacgagcctagcacgaattatgcctaactggttgagtgagagggtagaaaaaaacaataataggggtgtgaagtctggagtataatgatagcatcattgcaatatgatttctaggtagaaggatggtggccaagtggttggatgacagcctgatggtgtctaacagttgttgggtagggattggagaggagctagaactaaagtatcttatatgctaaacttgtgccagtcatggtttgcatgttgaggtatcatatcatacagtgtcatctttgctaatcacatgttcagtcatgtttcatggctaatggtgaagaaaatgggtttatgctggtccatatcagtccgtgctagtcctgcacaggcttacgtgaatcaacatggattagcatgcaatatagaggtacaaatgtctgtattttacctgcacttgtccagcatagtgtgtatcatatggtatgggctggtactgtacagtgacttgatcctttgagatgtccccttgtgtctgtacttttacatagatatcttgatatgtcaaagatgctaatgtttcaagaactggaggggttttttctgattgcttttgacttgttgttagatgcttgttttgtagcgattgtcttaagcatatttgaaagtctctctctgttgtattacttgtatcatgttatcttgctttcttgttatagatttcctggatgtgaagatcaatatgggcatttgtttgagtcatgcacacaaaattttcaacttagggttatgaactaactatcatgaaagcaatgagaaagtctagctagttactttttgctcttaaaagttcaggaaatttcatttgccatgttgccctagactgtcatgatgtcccattatattaaaattcatgcattaatttcaatatttttctttcagacagcaggtttaatttgtgttgaatgtgcacataaaaaatatctccagtaggactttaggatgcatgagactaggtgccactgatatgacatcatcataattacattgtagaagttagacacaattgctggacacccaatcatgaagaaataatcagaaaaatcaagtttctagaacctataagcttactggatcaattttgggcgtggaatttataaaactaatgttccctaggtggctaatctgactataatttacgataaatatgcagatattgattggtatcatgcaggccaatgtatgcactttatagcatgctatttttttataaaatccattttttgatttagatacaaagcatgaaatatgagatgattaaagcttagaattggtataaaatggctattatcattggtttctcttagtgtcatagaaagtaaacaaatgacattgagaaattgaaaattttactgagttaatagatgtaccattatgaggctgttttaggttaaaaattttaagttttggggaaaattttgataaaaacataattacagaaacttgttgtagagctaatggatatcctataatgaatgtgaactcaacctgaatgtcgtaagaaaatccgaatccgaatcagaactctattatattattaggattgttttcagatgttgcttggatccaacccaaatatggcctgtcaaatgttcttcctacccactcaaaaaatgtgaaaacaaaaaaataaaagaaaataaatattccttggaggattgatgttccttttcctagcaaatatgaccaagcatttttctttatttccatggtttgatctcgtcgaagactgatgctgttaatgtttcgtataaatgtgccattggttttcttttcttttaaattaaatattctttcactgtcatgtttatgcaggaagagattcgatttatggtcaacccagaattaattgttggcatgcttttcatggcttccatgggttgtaatgaggcaatagaaattgttggtgcagaaagattttcatgttatgcggggtaagttatttttatttaattttgtaaaagcaccaaggatatatgttgttggatgactgtttggctgagaactaaacataaaattgacatggtcctgtatagagttggtgtattggtggtttaattgaataaactgtttttgcaaatgaccacaattctttttgtgcttaaaatattctcattcatttccaaaaatttagatctttatgcagagttcttttagtgcataatgctgatgtatgttcaataatgaggtgtttctttccttggattgctaactaaaactgcttgttgtttctaggcttcatctgattaagcagaggaatgatgttagattgatctatggcaaaggaaaacaggtggcttaaattatgccattgaccgcctttgctttgaccataggactgatttcaaagatattgttacttctagaattatttcatattgttttaatttttctgctgttgagtaacttaaaccttgtgcttataacattttgtttttccaggctccacaataacttaattttcctggtttaatgatgtttatctatacacctcttttctacaccttgttcaggtggtaatctttatgtttactggcatcaccttttcttgtagcatgcataatcctagaactttgagtggaggaactgtatgcatctcttgtagcaaactcagcagcttatagagttccttcttagttctattgcacttgtgtcttattgcatgtttgatagccagactaggggaattatgattgtgttgtgtttgcctcctgatgaaggatcttcgttggtctcctctacttctgaaggtattttgggttgattgagctgcaaatcttttgccatttcatgtattgtgttaaaggatttttttttcccctattactgaggaaatgtctgcatagagggataatggttgcaatgtttagttcccattgttgagcttgctagtgtcgcaaatggatttgaaaggaatatgactctgatagtgtattttgggagtgtggactattctcattttgagaacctctgatgccattttttgcaacttgtatcttattgatgatatgcattttctgttttcttagatgtcaaaagcgcctatgaaaatagagtttgaaattttaagttgttattggaatgacacttatcattacaaagccttaaatgtagttaagcttaaaatcaaggttgactgtgttgctaccggagcttggactagtcagccgatgatacagtttggtacacctcggtgccgttctgatcgggcccagtcgacacagagagagggtgaagggagaatgagagaggaagagagagggggaaggagagagagagaaggagagagggactccggagggcagttgagcttgctgcaccactattgagctcggtggaagtcggaggagggaggaagggaagaagaggtaaagggacaagagactactggaggccttcggtggggccgatgaggctgctgcactgctatcgtgttcagtgaagattggaggggctccaccctcctcccgatcgaaataagaatttcagcccctattttgtaattttttttggatttatcatatgaagtcagtaaagtccttgttgtggtaaatctaaaaaaaattatgaaacagagaccgaagcccctattttgatcaagagggcggagcccctcctctggccttcattggcctcggagtgggcggtggccttgctagccctccaaaggccttcggggaacctccttttcctttcctcccactgccttcatcgagctcgatagtggcgcagcgagctcaattgctcttcattgtcctccggtggtccttctccctcttctcctccttgtcggtttttcattatgaatgtcagaatcatcctggtcggccatcggtacggttcgacacaccccgaactgagcagttctaaatcggacagtttggagaactatgctcaaaatagaatgtgccttagataaattttatggaggataagcagtggaggttttgaatgataattggagatcagctatctctatttccaaaggaacacttaaacaattcaaaagatgtcaactttccatgtattatttcaattatgctctcacagagttttttaagtagttctgctctgcatgaacaatttattgctaaagatatttcatcctctgatctaattcgcagaaccaagacaaatagaataggttgttgtttgcagttccgcctctgatattcagttatattgagctctagtgcctccataattggcttaaacattttcttagacctttttttgccttacgaccttatggcattgtggctactggctaacatgactccatgatcaatccctctcccttttttacgggaacaaaggacagtgattaatatctcatgatatgaacgtgacattatgcttgaattgaaatctgcatcttgaagaaaaataaggcaccggcctttggatgtagtgattgttgatcattccagagtagccttcagatcatattaactgccctttgagaaactggaatgctctgctcaccttcctcagaaaaggcaagaatctcaagatggatattaaatgagccctgcattcggctgtaatgtgttactcttgttatctgcagtctgacactatgcatgtgtgactggtgaaacatcatttgtctggccccttgagttgcttgtaatgaaagaagccttccaggtttgaagttgttttcccagttatttgcctatatctgatttatgagagtccttattgtgccagagcacttatgtcaagtctgaccctttactctccctcacccacaatactgagaatatccttctttagttgattctcaccagctgtgcttcaaaaaagggatgctttaaaataacactaatttatctaagatatggcttcagattaaagtgactttattgtaagcatgaatggtggagtaggataacaaatgttggtcagatatgcaaggatcatgatctttctaaaacattaatcatttgattttagccaaaactctttcattatatggaatgtgatatggattatttggtgtgttcacacatgaatttaatcttattttgtattgttatattttttatcttgagtttaagatttattcaatattacagctgtgtagtgattttttgactgaaattctgcccattgtcatggtattgttttataggtatggttcttcattctgttttgtgggtgactacctggataagaagccatgtgattcaatgggcaggagaaagacaaggattgtagcaatagatgctgtatgcagtccaggaattatgcagtacgaagtcgattgtctggttaggtatgccaagcctttattctcggtataatagctttttcaggacaattttttggaaaaaagcatcagctaagaaattgctaagatataccaacttaaagaagcccttttagcactggtttagtcatgctttagtatgttttctgtcttcaggacatttgttgtcatcaaatggtttctagcatgaagatctataacgtttatgctttcatctctttaatatgacatttgaccgttgttcattaaaaaaaaaaatgatctcagcatttagatttcgtaagtgtaacataattgagtcatcctgaatcaataaaagaaaatgcataaacaatcaattcaacatccacaaaccattaattacatgcacggtcaaatgctgatttctgaactcacttccatatccatctaatctaagataatgtagaaaagaaaaggaaatcttaataagcattaggaaaggaagcatcaaggtaatagcaaagaatatggtaaaatcataaaattttggttatggagaagagattcggaattttaaacctagaagttaatgaatagaaaaatgtcaaggtgcaaagcatcaacaattggatcgatgaagctcagttccttggcttacttttgttcctatatgcttaggataaaacataaccaagttgtatctaaaaaatcatcagccttgaacgtatttttatgattcatgcaggaaaggactgcaaggactgcatgtattattgtgcttaaatttatacatttccctggcagagaaggccaaaatagttacatgtttttttttgtaataactctttactctgtcctttctttatttttgctctgtagttcctccttcctgacactcctgaaacatcaagtgtttgacatcatatttggcatgtcttcatggtgcttatataaattatatgcttaggtgagaactaggttagttttgttcctatttcagactccatgttgctgtttacttgatacatcaacatgtcttttgagtgtgtgtcgtttgtatccctaagtagaacttttgttaattgctttcgttacttcaagctttttctctattctttttattttgttgtacagggagactaataaagcattttgtggatttttggatgcttcaaaatatcaacactgctcaaagatttttcaagatgctgatgagaacaataatgaagtttctactgctaactgcaacatttttctggtaagaattatcaataagatgcttactttggttaatcagcaaatatcctgatgaagggactccataaagtgatttaattgggccaagtcccttttctccttttctgctttcttgatcctgcacggtctgtctgattaggtttccttgttcctacacattttggccaaattttgccttttcctgtccatcattaatgctttttttagtttctgcacttaacaaaacaaaacttaaccttgatatcttaaatgcctgcatattttatgtatagaagtctattcttgcttagatgatgcagttgcttattgtggacttgattaatttgatgttgattgcctgtagtaactgcctcaagccttgatatacttcataaacaggtttgtgaagctaatgccaagcaagccaaagatcctgacaattctgaaaacaaaggtgcaagtaacttggacttgattggtaagactgaaaataaaagctgtcaggtaatagactctcaagtggatattgggattgcaactggaaactggggctgtggagcttttggtggagaccctgaaattaagagtatgatccagtggctagctgcatcacaggtattctctttgtgagattctgccgctgtccattgataatctcatttgagtctgtattattggggaatgttgtaaatggtggaatatgggcctgaaccatgcatcttctagcgggaatggcttttcatttctccccttggtataatctggtggctgatgacactgcatagttcttcatattgttcagtatggacttgataacatttaaagtcctagccattcacacactatgcattcttttataaagggttagaacagtaagagttacgagtataaatcactaaacttcttttctagtacattttcttttccatttgaagtccaagtatgacctaattcttgtattcgtgtggcttcagatgtctttagactgtcttagttatcatgtatttttgaagcaaagattatgtagatcatgagattatgatttccccctctctcctttttctttcctcttgctgcaggctttaagacctttcatccactattacacatttggagaagcagcattgcagagattagaacaggtatgcttcctgcttttattgttattatacagtatgttagtttgacattatgaaaatctgaacatgtacagtggataaattcatatttttatgatgtaaatcttgcatgtacttggaaaaatgtttgttctcagcatgaatgacagctctttttcctccctatattgtgagcttaagaccatggtgattcaactcattcctttgttcgaatatgtcttccataactgttggactactgaatgtggtctagaagatcgcagatgcggtttatatttctatctgattaaaattgcaagaaaaataattgtagtggctgatttcattatgatgatttaatcaggtgactcaatggaccttggtgcatggatggacagtgggtgacttgtggagcatggtagttgaatactcattccaaaggttaagaggggagactaatgctgggtttttaacttggctcttacctgatcacagcacatcaaatgacgtgcaatgtatgtctgagtagtgtcattcttcagctggtcttcagaagcaaatgtaattgttttttaaaattttctagttttaatatttatatttcttctaaggcgtgactcatttagctctttttcttttttcaggtgctaaactataatttggctgtatcactttctgatagccatcagtagtctcattgcactctgccaggagtgaaagttgttgggttttttcttttcctttctttctttttttttttgggaggatgaaggagaactggataggagggagggtggggggggatatgtatattcttttgtctaaattctgccaaatttaaaagaacctgcttagaaggattcctctaattgttggggcagtcataagatgcgtgcttttgttttcctgctggcatggaaatatggtgctcatcttcgacatcggtggcttgatatgtgtgctggagaggtatctcaagcaaatgatggataatgtaaagatgatgagagtaattttgcatgaatcttttctatgtttttaaaagcttacgagaagaaatcttgcttgctaataggattgcaagtgctgaattgtccagactgctggtggatattgcgattggcatgcattctgtggaaggtgtggggtttgtggtctcctcatttgtatggacaatgctgtggtgtgctgtttgattgctgggttgcttgtttttacagccagaagtgatgccatttggtcggtagaaaatcgggcagcaagtgcaaacattagcaggggcatgtgatgccatgaagttacattttctttaagttgatatgtagattcagtagatatgtatgtccaagaaccgtgtacttaacaagaagcagagaatggaatagctattcataatgttcctggcttcttgcagcattttgtgatgttggaaggctcccatcaactttttggtttgtcaattctgaacgagataaaagattctgttaagacctactatctccatgtggaagtgatgtgctccagataatagagaagagaaactatgtttggttgcggaataagttgaccttgagtaaatggtagatttatttctgatcaatttgataaaaaaataaattatatatatatatatatttaaatatttaaatttacatcaatatttttttaaaattgatatctgcatgtatatttttataaaatatatttttttggtatatgtatctatatcatctaatattgttaaaaattaacggtttaaaattaaaatgattaaaatattttaatagatagacgtgcaaaaagaaaaatttataaagatatttatctaaatagtaattttatgaggatatttacgtaaatttgaatatttagaaggatgtgtgtataataaatctttaacataaatatattttttttggtttgttaatttttttattattctaataaaaaaaattaatatatacaactaaaataataaatttattaatttatatatataatataatttttttaccaaatgatagatcaaaattattttatctagaaatcaaataaatcataactatccatatttcttctaatatataataatatatttttttaaaaaaatttaagagtatatatataaatagtaattttatatggatatttatgtaaattttaatatttagaaagatatatatgaaaaaaaattaatttaatttttatttatttcatctagatggattcaaaccctcttactctaaaatatagtaatatattatacaatataacaatatgatgataatattatataatatttatatattaaaatattatattatattttatttttatgtaagatgaaataattatgtccatcttataataacataatctaccttatatatttcacaaaaatatttttgataaatatttttaaaataaaatataataaaattataaatttttattgttatataatatttaaattcatagctacgttcatttttatgtaaatattaaatttgaatattttgaaagatatgtatgtaaaaaatttttaaaaaaattatttgataaggagttggggttcgtttggttgcaaagggaattgcctgcaaagtaacctttgttgaaaaaactaatcttctgattatttgcttaattagaaaataatgaatatgaaaaatcatgtttattttcctttaaacttttctcatgaaaaggtcctcctttgccttcttgtgttttataggtttccttggaatcaaatttatcccaagtcgaagaatcgttcatcaatttttgataacatatactttcttcttttattacgtttgtgattttctatcattttggcgttatggtggactaaatgaattcaagaggctttaatttcctcgttcaagctataagtaaagcaaatggatggaaactccttatccgaccggaaaagaaatacggtatccgactctggtgaaacgcattggtgcttttttttttttnttttgttgttnnnnnnnnnnnnnnnnnnnncctcgttcaagctataagtaaagcaaatggatggaaactccttatccgaccggaaaagaaatacggtatccgactctggtgaaacgcattggtgtcttttttttttttgtttgtttggtacaaaatatgtatcggtgtttgcggatctgtttgacattgtttttatttttgcagatcctagaataaaaatcaattagattggaaatatcgaagattttttatttttaaatttgattcagaaatttacagagatttttcatagcaaagatttattactcttttagatgaagagtaaaattaaaaatagcagaaaatttttgtgcaaatgcgatcagtatttcacaaaaatttgtagagtagcgcaaaaaaaaaaaccaccgtgccgttaaacagggggcggtgcaatgctccagcggatttcgtgcttaggttgagtgtggtattgtctcccggcggtgggcaagagagacgagtattgggcttgagagagagcaggccaaggtccaagttaggtcaggagtgggtcaagtccgtctacgttcggcccacttggcatccttatccaatcattgtcgcggtatctggggtactgagaagtgaacttccgtttggaaagccgtggacgcttgcttacccttcgtttatcccacaaaagccaccgagagtgctctcttcttgatttaactcaagctctaccagaaggcaagcaggcattacttctttcttcccctcaactgaagctagccaagagatcaaaacgaagttcatagtatccataattatctctttgctcgcagaatggcgttacaatgtccattgctcctcaactgttcgacgcctgttccaagagaagagacccatccccaagtcccacttctatccgctcgcttcgttcctccgcacccaaagagttacgggagctttaaactctcttcaacagttgctggtggtttcgttcccaggtccccaaaaccggtaaaaaaattctggttcccattgtgttacatgtcgtttcaaacattagctcagaactcatcaaactttttacatgccactactactgcgaagaaggtgagagcttccaaagcaattgacgtagtcctcggcgatgggaaagatgaagaagaccctgactccgacgaggaagaacagaaccctggtaatgatgatggcccgtttctaatgaccgaggaggagagaaaggagatgaggagaaggatcagggaggtgctcgacaaagcaccggatgtggaagaggagactgagccagtccagaggaagataaaaatgcaaaagcttttagctgactaccctctagttgtcgaagaggatgatcctgcctggcccgaagacgccgatgggtgggggttcaatttcgatcaattcttcaataagatcacaatcaagaatgcaaggaaggatgacgatgaagattatgacagtgacaaggagattgtgtggcaggatgataactacattcgaccaatccgcgacataactgcaagggagtgggaggatactgtgttcaaggacttcaatcctctgataatactagttcatcatcgatataaagagtcagttcttgttctcttaaatccacattcctacattgtggtatcaacaaatgtatctcattgaaatcatttcgatatcatatacaggcctgaagagaatgagagggcaaggaatgagctggagagggcagtgcagatgttctgggaatctgggttgccttcaccaagagtaagacatccaaatgcttgtctcccagtgtgagactagagaaagtgatcatctttcacattctaacgagaattatatggtggcagtgtgtagctgtagatgcttgtgctgagcatgatctggtagatgccctgcaggtgtcgggcttccctgaaatcctcttcacacatgcagggaagatactgcaccgcgataaaggtatacaagagcatcttaaagccctgcaatagatagttgaaatgattctgaaagtcatccccttttctgttgtttcagtagttcggacagcagatgagtggtccaaggtaatggcgtttttcttctacaaagcagtcaggccatcattcctcgataaatcagtaggccagaatcgagagaagatcccaactcttaaataggaggagcaagaattgctgaattatagctttttgtttctgctattagattacaaactatgttgtataaaaattgtaatgttgaaagaccaatttactgtaaaacaaacgaactcttggatcagatcttggagcacatcaattgatacagtagttagcttcctcaaatggaaatgtcttttttttcccctcaaacagaaatgttcctccaggtgaattaagtgtacaaaatttcaagtcacggtgcatgtgtgtgcatagaccagctccacctagtagcccttattcccacgtatccttgctctcatgtcaacctgaattgcatcaaacatgtttttagaattcaagaatgggaaataagatatcaaacaagccaaaaaaaatagtaaaagatcagttaatttatcttcgctgccccattaataagcatggtggtgcatataagtaggatgatgatcaatgcaataaaaacttaaagaggacaagtgcatgcataaaatcccaaaaaatgttgcaaatgcaattcattgaatagcttagctctgcactctagagatctatatatatatatatatagagagagagaggaggggggaaggggggggggggggttctcgtcgttctttctccagtctactttgtatttcttctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatattttatatgttaattggtaaaccgatctgggcctacacttgtggtaggccgttctggagaagcccatcattcaacctagccacccgtgggcttcgagctgttgctatgttgctacttcggggtaaggcggtaagcacacctacggtggtcgtcttccagaggtcggctccctcctcgaggccccgaactagggtttacatcttctccccgtctcccgctttcccaccagcaaattaaagcgcgggaagagggaagcgctccccctccccctcgatctaaaacggaagggggtctcgatttaagtgccgaaggagtccaatttcatggatgggaatcgatccaaaagagcatctataaaaacccaacaccccaattggaaggagaaggtattgatcttctgcaccatttcgagagctttggttaattacttttactctaggaatttagggttttgtaatttttaatagtttgtttgttatcatcaggtccattaattttccatgacatgatttttttttcccgaaaaatgatatcctagttattttaatctgataggatgccattatatacatgaatctgtgccttttttttttgttttcttttttgagtcaaatgctacttgtgggctgctttttggtcatccagtcttcggttattctttgttttgagtaagctttctcaaatactgcatcatcccttcaccaaattctaagattcaaactcatggacgagtcatttcatagtttctggatgatctaactgttgttattctcgaattaggttaaacaattgtcacagaaaaggaaaaaaagatgaaagacagttaaacaaatcatgtctccctgaaaacgacaaactcttcttgcatctaagtcaggatgatagattgtgctgttgcagttggtgcattctaaaagccattattatttcattttaacagctaaccaacttttaaattacaaacttattctttcaaacagtggcattgttaccagtccatgttatttgaatttgttcacatttggtaaccaattatagtttatgggtgatgcatatatgactttctcagcagaccctcaccataattttcatgctgcttcttatcactgtctttctcattttgcttgcatattctatctatttcagctttttttttactgggaattcctaaaagctattttaatcgcattgatgtataatatctaattgtatctcatgcagcttaggcaaaattgcctgagaagagttcaagaggagagagcccagttgctttggaaaatcagatcaagtgggcagcaatctctgaataagaaggtttgttatgcaattgctgttatgcttaacttatgccacttaattctacttttgcttttatatcttgttgttgaggtgggcataaaagcagcttcatataggtttcatcctcctgatgagttattaagattgttttcatgttgaacggtttactaatatcaataagactatcattcagtgaagggtggattttttttttaaaaaaaaacaaatactttgatgttatgataattgttctgctgacatagatgatcatcttcatttacatttaattgatgagttagatgagccaatcacacaactgacattttgtgaaaaaaaaactgtatacagatagtcacaagtcatgcataagtatttcagtctttaactccaaaattcgttctccttggcagggtagtttgttgccattacgtgtatatccatttcattagttgtttttcagcttatatcaatgagcaattttcctccaacatattaagatttgagaagcaagcattcaagtgggtgcaattctagtagcacatgaagtcaaagctacatgcttaatgtatttacttacagtaagctcgtcacaaaaaaccagggtttcatatatgtagagaaaagtgtacatacaattcatgggcatgcatacaaagtaattgaatacatatgtggacagtatactggaggaaacatgtcacagtgtctgtgtattatgatataaatacttctaacatcatcctttacattggatggtgcgccaagagttggtatgaagaaaaacagaccagcaatgcaataaatagtggatccactaagacaaagggataaaacaggaaagatagcatagtaattaaagcatgagtggactgaacaagggttggcctgagtgccaatataagggttacgagataattctcaatcctcaatggcaattgccgcagatgaggggtaattacctgtatgatatgtcaatttagctgatgctgtgcaaatgttggccatgaggcaagcttagtttatgtcaaaagaagctgggagagaccaaactggtaatcatgcaatgccacttgctgaaataggcaactcaatagatgttcttgcaagcatgttgtaaacatcgcaaggagcctaaatgtatggttaatacaaatttttcctagatttattgaaaactgcgacctttgcgagatatatgggaaaaaataaggaggttgatgaagtgatgttaaaaaattgctggctaatgaagtttgtaaacaaaatacctcagctgatagagacaattggaaacaatgaaagctggcgcgcaatagaaattgcagctcaaatcggcagttgattgtagagatcttcaggcatgcattgctaatagttagcagcagccagtgatggatctgccattcatgcaaaagacattttagtctcaatgatgccatgctgagggagataaactaccagcggatgctgcacaggaagaaggtggatgactcttgcttatggttttaagtgtggtaagcatggtgtagcatgcaagatgcagaacttactaaatgccttgctagcattctgtgtctggcataacactggctgcctgccagtacttggcatgcaagagtgccagtgtgtgccaatcatgggcaagagctaagttgatgcatcctaagataatggctgagtcaagattgggatgaacatgatgtatgcagagtttgattgaagagagaatggtcatgaaattgagtgttagtgctgaagaagccataagaactccagtcacccccccaccccaagtccatgtgtattaaacaatttggttgcttaatagtgatgttggatataacctggaaatatgataaaaaaagtagaaaggtcatattgcaggttggatcagaaggtgagaactgggtgttgctggaagcacattcaggttatatgagagggcattagagggtactatattgaggcagtgtccatgattttgatagttagtgggacttaatatcagcctatagtagcaataatcttatatatggtcataggtggctgaagaagacaacaggaagaagaatatgagtgttattttaatccttcaggtcatgctttgtatgtatgtttacttgcatcacaaaaatgattttgtatttcaattatatggaggttatggatgaattccttttgttggaaaatactgtagcccgtagctatcaggattgtccagcaaggtcatttgtgggcactagtggaagtcttgagattctttttgttgaactagcttttagccagtgaaggcatgatatttgggtaattatggtgatttaatccatattcaggacagtgaaataacaaaaaagggagggcctttatgggggatgactggcattggatcagtatttatgctataatttgatataaatatgtatacttatgtacttgaagtgcatataaatgaaactcagtgtaatgtgggtgatgacattgtgactagcttccatccatagtggtaggtttgaaaggctctaaagtgctttgaggtacaaaggttttttttgtttggtgagttttctggaagcatattcaagaggtcatagttaaatggtggtatgaataggtttgctttgaaaatctgagtttgttgcacttgtatattgatctttatactgtcacttgtttcactgagctgtcttcggaagctaaatcggtgcattatcagttcattaatctgttcaaatatttttttcaatgaaattttgttacttttaactcttttcttattatgtgctatacttctgtgaaatttgacaggagattgcggaaactgcattcaggaatatagtttctgatgagctgcagaagattaagcagtcatcttcaagcaaaaaccagataaccttgttccgaataatagtgatctaatatgggaatttgatggtctgcatacaagtagctcaacggaaactgaaagtgaagagctaatgttagaaatggagagagtactttatgaagatctgcgagaggaattgatcaggagaggtaaatctagcaacatgctcctattattcaatttacattgtttattagagtatgctgaagtatacatagtgttctacacatgtttgctttagagggaattacaaacagcattgctatttaatcatgtatgctgacaaacagcattgctatttaatcatgtatgctgacataatcatggctcaagaaacataccagactttgtaggatgatgaggtcatgtttcagggaagattatggagcatttaatgtgtagaagcctaattcgagctttacatgcttggtactctgtatataatattgtgctttgtaagctcatcttctaattcattcataacagtgacttgcacctttgcagcttatcttatttctttccttcaaaatacctgttagaccttgtttcttagtttctctttagaggttttagattccccattctagatttcttgagatattacttattgttcttctcggtggttcttttgtatgacaaaaatgtcaatggccactaaaagaataagcaacaagctctttctttttatgaagcaatgataattcattcaaatgaatttgtgtgtaacttgttgaaaagacttgagcgataaatctgaatcacaatattgtgagtatgaatttgtggaactacatatcgtgccaactcaatatagtttgttaactaaataaaatggtgaggccagtgagatgatatcaaaagttagcatggtgctctcaaatggcttgaatatcatctagcaacctggactattctttcatgtaattggtaatcatgtacaaaatcatatttgtctacagggcaatcattttatgcagcaactgcttgatctattacttgttacttcactctcttcgatcaactgcaggttttaattcaagctaaataatccactatttatttataacactgtatttgcacctatttgaatatgttgttcaaatgttttctgagccttgaaaaattggaacagcattttttttccttttcagtgcacttctgttattgttaagtgcaaataggaccagactactcagactctggtagtattttaacttaagttgtatgctttatagtattgtagttttagatcacatgtagacacatccttccatattacttgataagataatgaatattagaatatctgtatgatagcttttccacgcaactgtacaggtctatcagtatattgggatcataattgtaacctcttcaatgattgctactattacacttagtttggtgtcattatagaactggatatatgttaagcacaaggattgaggtaccatatgttgtcatgtcctggcttgtgctgtatcatatcattacttgacacgcaatggcacttcagtgtgccaaccactggagtgcagccagtgtcttgccagtgcctcgcatcaatatggcattggcgctagtacttaccattctgtgccaaccagcacttaacctatggtcttaactcaagcaaatctgtactgttcatgcagtttctttcaataatcattttctaattgcagcaacagtgagcagttcaatttcttgtttgattataattttttgatgattcatccctatctcttaatgggtggctaattaatcatgtacagagttagaggttcttgaagaagaagatgaatacttagctcgagcagtttttgaacacatgcaacttaacgatgaccaggtacgaacagcttataagcaatctgggtctttattaaattatgagcaactacatcgcgatgtcacttctttcaaacaatgctatgtacagaaaccaatgcattatttttttatattttacttgggcatgctcatgtggcaaaaatgtgagttaaatggactctgctcaaacttgtggccttttcattttgtatctcatgtaaaacctatgcatgctgatgtgcatattcattttttttcttaaaaaagaatacattgcttgctgttgatggcatgaagagtaggctcactttcacaggtttgatgccatattgtccaagacatttagagattgtttggatgtctgggcccaaaatcccatgagattcatgggttgggccagcttagctaagaaaaatgagcttgggctaggcttgtattcacaaatatctccctatgagattcgggctggcccactccaaaagcctctcaatatttatgaatacaagtctagtctaggctgattttttctacctatgttggcccagccaatgaattccatgggattttgggctcaaacatccaaataggcccttaggagtcagcttttctaaattcactcatcattcttggaacataggatgcaattttcagggttaataccttactcccatatgtcatgacggtcttgcagaaagtttccaggatttcaatccaatgggcacgacaccctgttattacctgcttcggttttttggtggggggtagagaatacctctgcgaaattaaacactattatttatccccaatcctaaggcggcattgtttcttctcagattcctttagcaggcaacaagttataattgctcctttgggaaatagctcctctagcctgggctcctctctgttgcttacctcccaaaattttcaagaaaagaaggcaactcatcaccttaaaaggcttgaaggaaatatgtatttctctccctggccataggttgccagaaaagaagacgggtggatcaggatacacctgcccagcactatgaatctttaagcttcaatcaagaattcttttgacatgctatgtataaagacctcattgggtccattgaagctaaactatgactaagctatgatgatgcacaattttgaatgacctcatgcctaatgtgtgtttccctgatgcaaattctgcccacactgacgtgcggtcgtttgtttctaatggggattatgtacattctgatgcagtacaaggactttaatgttgtcatatcgtctgcaagaaaaaggattatgtacatcttgatgtgacagaaggattcattggcttgtgtgttgtcatattgtctgcaaaaagaaaatgtactgaactgttgaagtcatgacaaaattacaaatcttaagaggccctaaatgatgtatgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggaatatcatcgcaaaaaatttttgcgataactttttacgacagtaattgcttgcatcataaaaaagcatcatataagatgtatttgtgacatttatttgcgatagaagataccgttgtaaataactttttgcgatagacccccgtgaccctcattctccattaaatgattaaattccatattgtcatttgatattaagattccagttgcctcttgtatcattccaaccatatcatctttcgtatcaaaaaaaatctctacttctacagtcttggttagacctagtagaatagtacgtctctccatgataagtccaaatcttatatgtcgtcaaaaaatcttttgtaataatatgttgtttcactatatgtcggtcttcaagaaaacgatttttacacttcttacacggacaataaatctttgcatcgtctgtctgattaacatatgcaaagtctaaaaatttattgaccccctcaatgtatgtaggtgaagtcttttctcgcaaatcaatccaacttttatccatagtagaggccaacgtgaagaagggtccttggtctcctgaggaggactccaagcttaaggagttcatagagaaatatgggactggtggcaattggattgccctctctcacaaggttggtaagagagtgattgagatccttatctcttttccttttctatacgtttcttctctacctgtttaagagggaacagacatgatcttcttttaataggagagagagatttggtgtcattatgtggatgatggtaatttggctggtttgattgttgacagggctaaagagatgcgggaagagttgcaggctgagatggctcaactacctgaggcctaacataaagcatggagagttctcagatgacgaggacaggataatatgcagcctctttgctagtatcggaagcaggtgagagacagcctcttaatacaatccagttctttccaaactctgtctccctcatcgatacaaatgtaaatcctataatcctgtacacattcctcagcctgtgacaataattattatataatattatatgcaaaggggaacctcctcacttcctccctgcttaccttcaaaaattctgacaggatggataacaaaaaatcaattagatatatctttttttgaggctgtaaaacagcacaaaattatcagaattccaactaaaaagaacctaatgaggacttgcaatgatcgaaaaatcagaacaataatcggaagaaaaaattaagggttaaacagagatcaagactggaagatggaacaaactatatattcctcatttgttctctctattcggttgacatcgaagagggagagatcgagaaggagagggagggatcgtacctgaccgggctggggcacgccaaagagattggggggcatgccgtggggagaggcacgatgaagagatcgggggggacgtcgaggtttggagcggcacgatgaagagatcggggggcacgccgaggtttggagcggaagaaggggaggaggcgcagtagggtttggagaggagaagaggagactacggtaggagaggggaagctgagaggtgagcgcgggcggtgggatgggattttattttatttttcacggtacaatgccgtcgcaaaaaaaaaacattaggcgccatgttaaaaagtgtaggcgggaggttttttatcacgacaaaatgccgtcacaaacaaaatataaaaataatggttcgattttttactactgtaaaatacagtctcaatatatatatatatatatatatataaattataaattatttaccacgatccactatcgtggtaaaaatcgtagattatttatcacggtgtattgccatcgtaaaaactctattttttactacaaaatttgattgtcgttacaaatagtaattaaaatttatatcttatttacgaagaatttttaccgtcacaaataaatttttttgcgatggtaaattaaccgtcgcaaataagttcgttgcaaaaacaccttttttttgtagtgtttattgatgataattaagggattcgctaacctttcttaatccacttgattgaaaaaaaagaagaagaagtgggaatcctagatcatcccattattgagaaaaatttaaaaagtgtgaagatttttttattaatcttaagtggcttgtacaattatgtgccgtatattatgtattgttagacaagagttggagtgtagggaagaaggtatcacacgtagtcaatgataacttccaaacgggttaggtaaacgaaggaggtctattcatgcacgactctttctacaaaggctctctagaaacgtaggtgccaagccaaagtcatgggcaaccaaccccaaattttcaataacaacctcctcacgatgtagaaaaatagtgctaccataatggcatgctggtccctgtgatgaaaggaatagatacgtaaatagtgaccacttaaaaaacacaaaaaattttatcccctgaagccttgttaatgaaaaattaataaatgactcagcagtcttaattactgtttctacgtgtatctttaagtttttatcgttcaatcatgcttgagaagttgttgccttctccaattcaaaggaggccacagtttctgcgctggtttgatagaccttctgtgggcttcactttattctaaaccaaaagaacaaaaaatttgagttacgtcccatggaagttgtctataaaatatgatcatgttaatttctagatctgtagacgtaggaaaaaaaaaaagctcattagttggcatccgtactttgcaggactaaattaatgtcatacaagaactaaaatgccctctgtccaacagttcgtttcctgcgctcaagttggaccagcttagatcacatgcgtggaaggtgtcaacaaaacaagtgcttgcatctagtcattttacacataccaaattaggattaacaaattaatttattagttggcgtactaattttgtagaattaaatcgatctggaacaaaaattttgaaatatatattcagactaaggaaatatttgataactcagctagctctagaagaactttgtcatgtcatgaagaagagcttaatggagagccaaaccagattatatatagctgtagttcttgattttgttcatatgtctcctttttatttttccacagcttctgataaaattctatattctcatcctaataaaatttctttatcactttacaaataactgcaatgccaattaccaatataaaacttctcatgtttcaacttagttttcttgtagaatggtctatctccggagctatccacaagcaaagagatctctttctattccctttcagtattttttatatcatcctcacatgcatattcccaccatatatgagatataaatacatttacaaaagataatgcccaaaagaggcttcaaccttcaagtaattaaccaacacaagtcaacctatacatttcaagagctccctataagaaaagtctggcaagacttccattgccaaccaaacaaaaagctcctccaagtctccaaactttcccatctaccttccctgcaaaacatggaaggattaatcccattcatctgtaggacaatcaagagaagaaggacccggaggtactacaagtgcctctcctccggcatggcgcagaggttcgactctgagagcaacttccatgccaacggccacaagttgctgccaccagtagtaccagacaagcttgaaggcttccatgaagaccacaagagacataggcggtatcggtcaatggaagagttctctagtgatctctactcgccagagaaatatggagatcatcgtccccgtttagctaaggatgtaaggtttgggagtcgtcggttgtttgcatgcatcagcggtgcatagaacgatagattatatgtgattgttgagggaagggaagaggtaattagatgtagatagaactggtttttagatttagtttgtgatgcaagtctttatgttaatgtagtttctttctattaagtgttccttaatttatcctttattgaaagagaaggtggctgcccagccagtctctgtgtctgaattgtagataagaaataatagttctccctgagaaagggaagaaaaaaatactatgaagtattttttagacaaggaaaaggactaattttttcaccatggaggaagaactagtttcttcctttttcctctgggtacgaatgaagtttcaattcttaccaaaatattacagaaaaagatgagttgtttgtggagctgcacaagtaattttcacagagtgctatgtgcacatatttgttcaggcatgttattctctgatttattgaccataaccattaaatcggtagttcagggtattgtgtgaattttttaaattatacaaaagcttcttgtgttataatattggctaatatgttctttaagacactagaatataaagagagtgagaggcaaggagaatatatggtagacatagcaactaaagcaaacaagatgtcagttaatttttatcagttttcatttttctgaaaagcttgtaattaagtttcctgaatgtctcagtatattttgtatttctcagttttcttgatttcaaatacttacaataatcttgatgatttatggcatagagcttatgctattgcttacataacaaattgagctaagattggaaaggtggataattggaaatatatccgagctttgcttaattttcttctcatcatttggtcttcttgttcaaagtaaggccgattggtaaaaccattttcttggctcaagattggctaagttcaagttctattcaagaactctatgatatttttgaagagttttgcatgaaaggttagaaagaaggaagcgctctatctttattaaagaaattatcatgcttttagcactaatgctgtgaacatatattatatccatagtctaactatgttgttgtcattatatgatggaagttgcgccaacaacttctttatttactaagatagtggttgcaccttcctagatcttgcaggtgaatccttaaatatttggactttggtaatttatgtcatatgggtctttcctctgaaaacagacaaggacaaagatttacaaatgacgatcctcatgattatgctgatgaaaagaattttgaaatggacgatctctcatgatgtttcctttgctgatgaaagcatgatattgaacttttttttaccaaagttgaaaacttatatatatatatatatatatatatatatatatattattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatatagaaactatggatggatatgccaatcataaatttggaatgcaagtattgatatgctaacttgttgatggttatcttttggaatagtctaaaaaatgcatatgttattggttgtatcctttctgaaaaagaaaatttttttgtacaccacaggcggtgtaaaaaatccgatgtggagtacaccgctttgtccgattgatccacataaccatcacttttcaatgtgtatttaatgcctacagttctatttttttgtttgaaattttgaatgataaaaatattcctcctctttgaaaaaaattatgacatcctatggtatattatgatatcctacgtcaaattattttttacacatagaatgtcataatatggcctaagatgtcataatatagcagggacatatttatccaaccacttttcaacacatatttaatgcctagctacaattttattttcttgtttgaaattttgaatggtgaaaatacctctcctttttgaaaaaaattatgacattctacattgaattatgacttcctgcatgcaggatatcataatatatcccagaatgtcataatatgtgagggatatttttgcatttattgcctgtagttgtatttttaatatgtatttattgtctgtagttttatttttttcgtttgaagatttttaataacgaaaatatctttatttttttaaaagaattatgactttctttgcatattatgacatgctgcgtcaaattatgacttcctacatataggatgtcataatatggataaaaatatcataatttttaaaaaaaatgaaggtatttttattattcaaattttaaataaaaaaataaaattacaggcgttaaatgcatattagaaagtagtaactacgtagatcaatcagataagatagtgcgctccacatcggattttcttttgggcgcccacggtgcataaagaatttctcttctgaaaagatatatctcttagtagcagttgtattcttttttgcaaagaaagaaatctctcttaataaagcatctcattgaaaagcatatttcttagtatataatctatcttttggtgtgcgagattctgtgtgggcatatatttatcctacatcgattatttctaggcagatcttggatatttatacaagactaatcaatccaaataatatcttctgactatttttttagaaaaaatcctgagttgttacaaatagtattagaattgatctagtccatagtctatgtggactaaagaatactgcagtatgggttcagtaaggttgaccacgagctaattgtggtatttatgaatggatgcatggatttggaccattaacattatgagaatctcagagcttaaatgggggagtatgtgaggactgtgcaggtatgtatctagtcctatatcgattattcatcgaaaagattttgaatatttatataggaccaaagaacctaaataatattttctgactagcctttttgaatgatattctagattgttacagattgtctataaataagtgggatcatttaggagttgtgtggccagaaaattatgttttccaaggatacttgggtaaaaatcttcaagttagcaatttattcttgaggttatgtgctatcaaccattttcttccaacaagaagttctatcttatatgattgaaaattggagaaactaaatagcatgaatacaaatttctattataactccacttaacatcaaatccattccctaaaatctacccccaaccatcataactattttaacatattctaagagtttatctacactagaaattatacttaaaaactcttaaagtcatttaaatgatatgaaggttttatagcaacctgtaattgtgatagtagcatcattcaatggtataattactatgtcgaattatattatgttaaatagaaaactacattaatcaagcttaatatctagtacattatgcatttgattttattggatagactaactaccttcatcaaggtccgaaatttttagattattcaaaaaagactaccaccactggtggaattgaaaaatattctatcttatctagacctccatcctttatttgattaatacgtatatgacatgcaagtataaagattcaaacgctcatttctttaaagttaatattggatatataaagattttttctcgaaaaaaaataatctgataggaagatcctgagcttgatatgattttaatgtcaataactttaataaaattaaaaatttgctttatcaaaatttagctcttctattgctactattaaatattatatttttcacattcgaaatatatgtcattcagcaaaattggttcagaaaagtaactcaaattagagatttaggataaaaatagagatttaccttaaataagataagttattcccaatcaagtaataggaacaaaaaagcatgatggattacaactatgcatcttgattttcaacttgtaattgagcctttattgagctagctctagtttaactttatttaaacacatgatcaacctactctaaatagactcgtatgtaatagttaagtagtcatgggttctaattatccaaatgaaaaaggaccttgaatcatgcttagattgatcgacttaatttagtagtagtttagcaacggttctggataatgttttaagacttaaacaagcaagctagagcattcttgataatatttaagacctagacaagctaactagggcaaccttcttgacccataatccgaaagtctgtatttggttaatcttgaacatctaaatccaacaaattccatcaaacatattaacctaggtgttccaacatgtcattctctccagattttagaaatcattataatattataatcataatctttactaatttcattacaaaaaaatattcatcgataatagttttgtattgctagaggtgcctttattataacaaatatcaaaattattattgacggttataataattataatggtcattaattatttcatcctttattagttgaaattatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccaagaaaggtgtatttatgttaagagttttttacatgtagatctttccaaatattcaaatttatgtgaataccttcataaaattactatttacatatatattcctataatttttttttttgtcacatctatctataagaatattttagttattttaattttaaactgttaatttttaacggtgttagataatatgggtacatatgcaaaaaaaaatattttataaagatatacatgcagatattaattttaaaaagatatttatataaatttaaatatttaaaaaaagtatatatatatataattttaaaaattaattaattataataacaaccattgtaacttgagaatgaaaaccaaacaaatttggggcaaatttatacaattttaaattttaaaaatattattatatttaggggggaaaagaattgttgatatatgtcacgtaacagccagtgtttaagtacttgtaattattgtggacaagttatctggcttcctctggaacggctaatattttatatcagggttgtttccaatggcacaccttagcccaactctggtacgatgagaccaacttcgcggaaggttcatggaaaggtcgtgggcccaatatatattgcattgcacctttaaagtcttagcccattccaacaatattataaccatggcccaccttggccttgcagcggtctccttactttccttggaagtacttttttgcctttttttttctcttttttttcaaatatatgtatgaatcgtatatgactaccatagatacatccaacaaatcagaaaataaaataactctaagctaaaaagggatagtagcaatgttcatccgtgtcagggattcggccttccatctgccatatatcaagtccattgcagaagacaatgttcagtggcatgtggaagcaatgtaacatctgacacatataaggagttgggcttcatgcaagatagcagagattatcttattactttaaccactcacaacttaccacatagccaatttttacaaccttggtttaggtgatcatacttcaaaattttgtttcaatgtctcgcacctagagctgatcatgagccgagctggggcacttaaatgtcaaattttaaataggctggcccaaatatgactaaacaatgaatatagtttaggcccgaagcccgcccaataatcaatcttgctacctcttgttcaagcatatatttgctttaatctcaacaacgtggtatatatatattcaacttttgcatagttataggtcattttaatagcctacaacctatattttaccctaatcccaatcttgtctgatttatttgtcggcatgcaactttgagtggaaagagattttcaccatataatcaccatattactgcaactaatttttagcacatgccacctttaattcttgggaagcatatcatttcatgtatctaaataacgtggggtgttttaaggctatatgcaactacaattattttatttgcaacaaaccttatcgcagcttgattttctcaattttgtataatctattatttgatgtgcaattttaaatggataaaaaattttattttatgactccggtcagtcacaaaccaccatgtagtcagttcccacaactttggttttaagtgatttgacactgcagaatgtttgtttcggtgcctcctacccccaatatgtcaagaagcatatctttacatttatctcaacaatgcagcatgtatccactgcttgcttagctatagatcgttctaacaacatgaaatgttaactctagcctaatcataattggtagaagtcgtcggtatacaactttggatagaaagagaactcctccatgttatttcaacagtaatgtgctaacaagtattcaattcctacaatttgggttcaaacagtttgatacttaaaattctcttaagtttgttagattcatttatccatatgcagctttaattgaaagttggatcttactcattactctagctagtcacaatggaacatgtactcaactccaacaatctaggtgcaagtgatttgatactttagaaccttttttttttgtgtctaccacctccaattcatcaaaaagcatcatgtggtatgcatatcaacaatgtggcatatattaattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatatgtggtccaagttgagcccattagaaccccaccacaccctgcccagataaaatgcactgaaagtgatttgatttcagagccctacaaaggaaagccagccctcattgaactttttaaaaaaatccaacctcaccaatgttttttgtcacactaacacatcatcaaaaacacgggcagcatgctcacggtcggcactaataaagcagcagcaaaggagagagcatccattaacggtgctccaaatggaaagcaaaacccaaaccaaataaagtaaatttattgccggggtaccacctttccgttggaaccacatcgcagccgtcggattggacgcgtggcatgcatcaagcttttctgggattgaactcttccaacgagtactgcacctcggctgagctcctccatctctcagacaaacctctagaccctcccccccacctctccccaccggggataaaaatccttccttttttttttttccacactttcttcgctcttcgctctcggaaaatctagaggtttagctgtcggaaatccattcgaagagttcgtcctgggattgaggtttggtttgcttcacttctctcgttttctcgatctttaatctcttctctgggctccggaagagcccaggggaagagattttgggttttatttcttttggttatcacctgatgcgtctgaatcttgttcaagatccagtgctttccccctttttctcagctttgttcgctttttggaaccctattcgcatcaaaaattcatcaaaaatcggatctttcggcgtttttttcgatccgttcgcatcggaaggcattgaagaatcgaatcctgtggggtttttttggcgtgtaggaaatgtcgtacccgctggagcagcaacagcagcagccagcgccgccctcgccggtgtacgacgcggtgtcgacggcgaacggtggggggtcgtacgggccggtgatcggcgtgctcgccgtgatagcggtgctcggagtgatcgcggggatcgtggggcggctctgctccgggcggaggatattcgggtacggctacgacttcgaggggtggatcgagcgcaagtgcgccgcctgcatcgacggtaggttggagctccgtccgccacaggcggcggctgcggcgacgacgggaggagcggggccgggcgcgaatggaagcggtggagctgctgcgggggcggcggcgggaggagcgggggcgggcggtaaacaggcggcgcagaacccggcgaggacggccgagacctgagtgggttctcgagcagtatgtggaatggggtcctcctcctttttttcctcctttttttttattttaaatatttatttgctcttttcctttttgtttatgcttatgttgggtctttggggagtctttgttagtgtggcagccatggcgtcacatttcaaagtgctgggggtgatgttagaacttgagaaggggtaccgtgaaaagaaattgagtctttgttctctctatctctctcctttcttttatagtctcattccgtgagtttgtcaggatgcgtgtcttgtgtgtgcgtctctcgtggtaattatgcaagttgtcatggaaaaaaaaaaaagaaagatcgttatgcagtaaaagtgggaccttttaagaccacttttagctcaaatgaagcaggcagttgcaccacaagataaatagtttaaatatattatattttatttaatttttaaatatttatatatgtgtatatttatatatagtatgtagtatttagtatgttgaaattgttacaggttatacccacgtagatttgtatcaagaaatgttcatgttattagctctatatattaattagatttgggaaatggtatgctcaccaagatacatccacaaatggtaaacataaaaattgtatttaataccagttctttcttctagggaataatatccaccctaagtttcatcatttttttaattcctgattgtcatcatgtgtattcgcttatctctcagtacatacatgattacaaataattttgtatatatagatataagtatgtacaaggatggtataattaattgtgcacatgtacaaggatggtgtaattgcgcacaagagtgtgtgcaatataaattcaagaatgagaaaatcttgtataagggtgtgtaggactacgactaaatacttgtggttaaggaaatacatgttaaagtcagattaaagaaaagatccgatattaagctcttcaaaaaataaataaataaataaataaataaaagtgtcaaaccatttctacatgatgccaaaagagggatttcatctttggaattcccatcctagtatgatccaacaattgggggatgagctccaatgattggtttccattggatcttagtgatgtgatgtatttaagaaaatgaccaactgtgctctaatttttttcattctacctccattgattaattaggaatgcggcaatttttttttaaaaaaaaaatgatattaagcaaagttgacttgttggatgttgcaatgcttaaaatatattgatggaaagagatttaaaactatatttagcgtttgcttggcaaaaatctaacccactttgatgagattgatggaacgagagtgtgccggggatacggaaagacaaagcgagaggagggagagaagggactaaagagagattgtggggtttggagggcccgatcctggaaggattgaaaaatctaaaatggtcttttccttttccctgatttgcaagaatccgcaatcttaacatcaaatgcaagaaaaacttaattcatgaactatatttgttgtctaggctgcactgtaatctaccatattttgttgtgcttgaacaaaagttcagacttaaaagtagtgggtgagatatttttggtggtaatgatggttgatatgagcttcaaattgaagattctatgcgtctacaaatacagttcatgacagttttacataatctatcgtataataattatctataggagggtcatagtgtctcgtgctttaatttttttctatataattccttatttgtctttgttatatgcctttgcctaatccctggcccctaaaacggtacatttatagcatatactaaatataaatgttagattaatatcaaagtgaataaccttgaaaagccagagtcagcatctaagtaaaaaggataaagtataatgcctttagatgattatcagaaattaaagaagaagaagaaagatccacctgcattataattatctagatccaggtaccgataatacaccattcgatgctcgaatacataatctttaattgccgagaagaaaggtgtgataactgagataaaccccaagtcacagtggccaaccaatttgaatgattaatacattttgatgaaaaatttgcaccttccactggcaccacatataactgcatagtctttcgcacttttttttaaaaaaaataaataaataaacataggtctactcgatggttaattactaggcatacctatctaaaataaaggcaagttaagaagaacgatccatctgggatgtaccaatagattactacattccttccattacggcaagtgttttctaatttttatatggtaggctttggttcagaatatattaaaaacattccctaaactgggacaaggggaaggttgtcatgtggatggggatattaaatgcttaagcttttatatccagagcacggcactgatatggcgggggctcatctgggaagagtccacatgattagcttcccgatacggtaccgatagttgtttgttattccacgaaatctactcgaatggttactgcaagctcccctcctcacatctctctctctttgttaggttggtatggtttgaagggaatagttattccataagttatcctattttcgtttggctgcagctcctagaataactcatcactcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaaaatatcgaacatggtcaaatgctagtacgattagggttttatctacatcaagatttgatgtgaccagatttccaatcagacggagacaatatctcctccaatcgaggtcaggtgcgaagaaaagcaaggctgatgagacgtgctaaccccgttccttggcttgctccgtggtgcatcaaccaggaacttgcttgcttcgtgatatcattgccaaaattttgtgaccatttcgccaaccagcccttttggttgaggataatctgacataaaaaatatatcatattatataaaaataataaaataaaaaataaaaaaaattataaattttttaaaaaataaaataaatataattaaaaaatagtacttattttttcctattgaattatcgaatagagacaacctgaaatcattatttttttggaaaaaaatattctctaccatatgatattaatattatattatatttaatattaatataataatatattattttaatattttataaataattataaatatattaatatttatcaataaatattaattattaataaataattaataaatagaggttagttaaaataaatctaacataggatttattaataattaaaatattttatttatatactaaaatttatttaaaataaaaatatattttttaatatatgtataattaatttaagatatttattaatttatttaaatatattttaatatttgaaatagctaacattgataatatttatgtaagtggctatagatggctaacaaatagatcgagaaaaaaatattattttttattttttattttaaaatattaattattaaaaatttaataatatttttatataaaattttttctaatcaaatatagtaattttttttctgatgctattttatggagtgatttttctatcaaccatacacaataaaatttctttccttcataatcatttttttagattaaatgattttaaaaattattaaattgttccataatctcatattccccaaccaaatgaacttttaggctcgtaggtgtccaattttaagagataatggctaagttaatctctccttatttcctaacatacctcgcgataagaaccggcaaagagaagcatgtgaaaggcttctatcctgtgtaaaactttgcatgcagtctctctccaatctggaaatgcaatgcatgcattctcttgtcacatgcactccatccatcatgtcgactttctccggccactcgaactgttcatcatgtgtagtacctctccagtgcatgctcacatgcatgtccctctcaagccctcatgcatgggtgtcaccatgaacagctgcattggataatattattgccagcccatttgcgagaatgaacacggcgtgggaaaaggattcgttcgatcacatgaggctatttaggtgttcttgatcttaccttagactcatcttaaacccagttgacagcgagttggttaatcattataaatataatatctataacaaatcaatgatattattgatttttttttataaaaataatattataaatacgaggatcaatgtgaatatgtatttagttctatattagttattcgttgaaaagatcttgagtatttatgcaaaattaaaaaatttaaataatatatctttcaactaatttttatagtgacattctaagttattataaatagtattggatcgaatcgaatgaggtttctaatttattatccatatggactggagaatactacaatacagattattgagattgaccacgagtagatcggagtgtttatgaatggatttgtataaatttagattcttagcccgacgaagactcatgcgactatgtatttagtaccatattgattattgatttgaaagatcttcgatatttatataaaattaaaaaatttaaataatattttttgattagttttcgatcttagattattaagtaaatcttgaaaagatctttgtgttgaatttgcaaaaaaaaatattgaaaaaatctttatatgtccataggtcacacatgtatatccgattgctcgatgaaaaacaaatacttgatggaggtctcgcatgtgaacaacaaaatacacttgcggtagagcacattatttgtggagtgaaactggatagggctacggtctcatatactctgtctacaattgcaaatagtcttgtggtgatatcattctttatgctgctgctgctgctgtcttttgggttacacttgcattcagtcatcctactttgtttttaaatgagaagtaggatctcctcacatgtaagttaccgtttcttagaaaatctccacgtacacatgtaagttactgttcatggcaatgtgtgttggtatatattatcaaggatcttgtttgtaccaggtgaaacattgctagtacctcccactccaattcgtaaatctattcagccaattcatatcataatatttatctaaaatataatactcattcaaaaaatataaaaaaaatattttgattattaagttgaaaaatttttaaatatttatataaaattaaaaaaatctaaataatatctttcagctaagttttttgaataaaatcttagattgttattgtagactttgaagatattgaatttgttaaaaaaatattaaaaaaatttatatttatagacaatatttgatgaaggtctcgcatgtaaacatcaaaatgcacatgcagtacaccacattatttgtggagtgaaaatactggacgggggctacggtctcatatacttcgtctacaattattgcaagcagtcgtgtggtgatatcatctgttgccttgctgctgctgctgtcttttggattgcactttttacccttgcgttcggtcatcctactttgttttcaaatgagaagtaggatctcctcacatgtaagttactgttcttgacaatgtgttttggtattatcaagaatcttgcttgtaccaggtgcaacattgcaagtacctcccactccaatacctaaatctatttagccaattcgtatcaaatatttatgtaaaatatatccactcaaaaagcataagaaacaattttgaaacgtctattaggtctatggattgagtctaggttgtgtgccggaatcattttctattgtgacaagctgattgagtaaagacacacaaagaaaaaaaaaaaaggaaaaaaaaaagagacatatataatatctaaatgatttgatttattgatctatgttagtagatagaaatgatgctaaaattttattctaaaaaattagagattataaagtacaagattttttcataaatctttaatcttatgttgtgttcatattcatatatagttgaattcaagaaatccaaatttcaatcacaagttgaagcatgcaaggttcaatttttcttgatacaagcatgcaaaattcattactgaattgaaaaatatccccttctcgatctggagctgctaaaaaaaaattacagaaactcctactcaactttagctcaattttacttacacttctatattttaaaaagtgtcaaactagtcattctaattaatgtttcaatatggtcaagccattcattttatcaataaacggttgtagatttctctctcaatgaacaaaaatgttctttattcatgaatggacttggaggaagaaaaagatgagaagaaaaaatgaataaggaaagagaggaggggagaatgatcatggataaggaataggttagagaagaagaagaaggataagaagaagaagaggatgggaaggaagaagaggaaaaagaatgggttatcggtaaaaaaggatggaggtagaagaggccatcatgaagaggatagtttatgggcgatttagagaaaaaagaggatgaggaggtgaaatgaatgagcaaaaaaaggaagtagagggagccatcatgaaggagaaaaaatgagtgagaaggaaggggagggaaggatttttttaccgatgagaagaggtgaatgtagagggagccatctaattaaagagatagggctcacgggttggtttggagaaaaaaaagaaagagaaggaagggaaggagaggagaagggccaccggcaaggaataggatggaggatgaggaaggagaggagaagaggatggggaggaagaagatgaaaaaggtaaaaatggatgaagatgaaagagaccgccataaagagggatggtttataagtggcttgaagaaaaaaaatgaggagataaagtgcatgggaagaaaggagaggagaaaaagaaggaagagaatggatggagaaagtgaagaaaaaagaggaggagaatgagtgaagaaagaggaggagaagaaaggaggaggggggaaagaagaggaaagagaaaaggagaaatgagtgagaaaaaagaggaggaagaaagaaaaaagagaaagagatacgccggtcatagaggaggaaattaattcaagaaaaaaaggaggaagaaaatatgtatttttatcattttaaaaaattttattaataaaaatagatgatttgctcatatatttttaaaatatagaaaatataagtgaaattaaaataaaattaagaaaatatttttataattttttaaaaaatttcttatatcatgcagcggtgatgattcaatggttttgatccagtagattaagatgcagcaagatatatgtcttgcttgttgatcaatcatacaccatcgcgagaaaagcggatgatccatgattgacagagcggacctctttattttgtctcgtacgtgtccatcttctcctggcgcacccagtggaccctctccatgatttaaagctataaagaggacaataatatcaaactcaatagtagtatacattatttatctaagtacttgttctgccgccctcgctccgatgcgcttcgagctcttttctttatccgatccgccatatcggatcccatgtgatccgacgcagcttttgtcggtgtaccgcaacacgctcccctcgtacgcgccagaaccgatcatgatctcatcctgaccgtccgttgggtcatttccgtcgcctcggagcctcgcgtttcgtgctccatggtcgggccccctcacaataattgagagccgcgtgcgtttgatccagcggattgcatcgtatggttgtctcgttgtacggtctagatatcatcaccattttctttttatccacccctcggtgcttctggtacattggtaggcgttggctctgttttaataaataataatacaaggctgcaagctcattcaattcactcacctaggtttgtacaaggtttgagatgaagggtccccataactgtttctggtccgtatggtaagccactatttggagtttggacttttattacttgatctctctctactctctctctctctctctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttttatgtttttatatttataatattaattaactaaaaattatacatatagagtagtatatcttcatgcattgattgcagctcttatttggagcatgaaagatgtgttatgttgggatgccaaacaaatagagagactatatagaaattttctattttagaaatgggcaatatggagacaaactgaatatgcacaacttcatagggtgcaggatctagaatcaaatattattatatcatggtgatataatgatttatttttggttgaccatatggtcgaacaagtgacccttggcttagtaattttttgggtttgatgtatggtccagattttaaaacattgacacaaatcatcatcagagaaattaatcgaaaggaaaaagccacaaagttatgtgttgcctagattaatcccccatgcctctgccctatgcttaatggggcatgtgccacatgcatggttaggccatgcatcgatgtgccatgtgatacaccaatgacgcccaataggacttgacgtgtgtcacacactaacctgcacatgcatgagcacaaaggatccgcactcgtatggtgttttcctcttggtaccatcctcaagaacatcacctctctttgaggccttctaagggtaggatgcttttaaacattgccatgaatagatactattatgtattaggatatacttatggaacttttcatgttggtaatgtcattcaattgcaaagaaatttgcatcaacatggtctatatatatatatatatatataaagcaaatttcatattcaagtgtgataataaaaatgctaaagttatatgcatgtttaggtgaaaagcatctatgatcaattcgaaaattgggatgcaagatgacaactatactgaattagaaagtggtgccaatcaacaaggagaattattgattagaatagttatatcatgtgttccttgcaccatccaataataagtcagcacaccatctaagaaaatggatattttaccatttaaagtagtaaaaattgtcagctggccaatcatagttaacaattaaactttttttatttaaaattgttaatcaagattggataatggtgcacctttttccaataatagatgatgtgcttgtttattattggatggtgtagaatccacatgatagaactgttctaaccaataatttctcatcaactagggcatgttgagataaagtacagggtcattaaaagtaattgaggaatgctatgggacctaaccctagtacaaagcaaagttcttttactactagcatgccaaggtgattggtgccatatttttagtattggtacaatgcctagggaggtcgttatgataaaaatattggagggattgcaaaaaaaaaattcaaaatttttctaaaatttccttcacacattttaatcttatcttttaattaatttatcatttaaagatttatgatgccattaattttttcattattattttttttaatttctgaccactaggctcctaattactaagtggtcatatgtatttaatcttatttttattttctgacagttgggctttttattaaagtcttaatgggtcaacaaaagttcaaacgatcataaatgattatattggatggttatagaagggtcacctgatttttctcatctaatcctcttcctctctttcttctagcatcttttgttctaatcttttttttaataattatttttttagatactaaaaggatctccatcaacctttttcatggttgtgctcacagatggaggatcttgattgtatcttaaagtagttttttcaatttgttctacacgagagatggaaatacgccttaagacagtatccaacatattttcaaattggattaattttatattttgatgttctgtaagtcatttataatttttctatcatattattttatttagttctaaattatgtcaaaaaattttaaagttctcttccaacaaaaaaagcgccaatcctcttaatacatagctctccaactattttccagagtgacctgttcatcctcctccattccatgaagcagcataattgaatcctatggatgatcaagtgattacaaagaatacaagagaattgctcagggcttcgatacattacaaaaattcacactattagtgacggcaactagccgtcgctaatagtccacatacagtcgctaataatctcaccgtcgctaattccgtcgtaacagtcaatttgaaaaattctgattgccaatatctttattagtgatgaaaatcctacctgtcactaataaggctattagcaacagctttagcgacgaaagaatttcatcactaattattttttaatttttaaattagatttttaaaaaattttaaaaaaatattagagatggtaaataccgtcgctaatgttgtctctaatttttttaaaaaaatttaaattaaataaattttttaaaaaaattttaaaagtaagtattagcgataatattttccatcgctaataccattgataataattaattttatttttttaaaaaaataattattatttttaaaatctattttaattaatcataataaattataatttttaatatttattacaattaaaatctaaagataatatgataatcaaaaattaaaaactaattatattatatataaattatataatttttttacaagcaatattaaaaaatacaatacaacaaaaaaatcagatccgatcctcatcatcatatgcctcctcctcctgctcctctccagcaattggtggatgagagtcagatgtcccagcatcctgtaatgaaaaaaataaaataatattagtaagtttcaatacagaggcatatctttcggtatacttcttcgatttttgaatagattattcttacatattttatttgatgatacggagctataaatacctccaacccatcgattggatggttagattgaatttttattttctaaatctacttttcggactcaaacctaaatatatgaagcttctaaatataaaaacttaaaaaaagtaaaaaaatttagtaatataattatctaatgtgatggatgggatgatgagcccaatcgatcgcacaactataaatcctagagaagctccatgatcgtatcgcagatggcatccaggaggctctgaagtcgctgactcagaattactaaagtattagagtttaccacatgacatgtgtaccgtagaactatgtgagctggctacataagagctctcttttccagtgctccctcctcgactatgacagctccgaccttagaaagatatgatctataatctctaaaaataaatataactatatatcaaattgtaataactatgcactaggataaaataactatatatcatatttatttaactgtatatcatgataccttaactttataccacattcataaaagtaacgtgcataatttatgactaaaaaaaaatgagtaatattagtctgaaacataaatcagaaaaaagatatctaactgcatcaatgggatacttttgtccaggtcttgatgatgtacgattcagttccctttcgagtatcctagtttctgtaagaagtagttattcttcgatgcaaggcaacttgtcgcaagtatttgtcacccgatggagtttgacttctatctttgtagccatgcaaaccaacatattatcatgtactgctggatgagaatcatttttttgctgatatattgtatatgctaattaacaattttatataacatctaatcattctgatgaaggatcaatatcgattggtgggtctaaaaataggtctgctatggtacatcatctgccgcaaatcaagaacaatattactagaggcatcaagttgatctagtaaaataaatagatatttaagtaagtggaacctcggtctttgactttctagacttgtagaattccaagaaaattattatttacagagggtatttaaggaaaagcaagttccaatctataatgtaccagtaagttgttgctccagggctaatgacctcccaaaaagagaaaaaaatatgtaagacttcgaatatacagaaaaagagatcagttctcattgcattaaattttctgttgttctaaaaaatggcaaacaaaatctattggtatccatcaggttttagacatcatatgggaacaagaaaaagagcccatagtaatttatagaatcattcccttcaatatccattaattaagtttgaatcattatcagaaaaaataagaagacaaccaaaagaatatagcaagtaaaatccatcaacacccatcaattttaagacatcatataggtagaaggaaaagaggtcagtcctttcaatatccatttagtttagattatcatcagaaaaaataagaagggcaaccataagaatatagcaaccaaaatccatcggcacccatcagctttaaaacattatatagaaagaagaacaagaggccagtctcttcaatatctatttagtttggatcattatcaaaaaaaattaagaaggtaaccataagaatatagcaaccaaaatccatcgacatccgtcagttttaagacatcatatgagaagaagtaaaagaggccataatataatctcaagtctcatgcatctaattgatgcggcccctatcgtcgctaatactcacaatagtaggtgcactggtgcagagacggggccgcagggtcgaggccacgggcttggagcggtggggcaggagccatgcggtcaggtcggcggggatggaaccacaggaagcctaatgggataggggccgcaaggtccgatcggcgggatcaaagtggccgcagtcgaggcaaggtcggggtggctggctcaaggctgcaacataggaggcaccggcagggtcggggtgatcgcgggcgaggcgaggccggggtggtggactcggggccatggtgtaggaggtgccggcggggttggggtggccgcagacgaggtgaggctggggcggctggcttggggtcacggcgtaggaggcaccaatggtgtcagggcgatcgtgggcgaggcggagctgggacgactggctcgggaccgtagtgttggaggcactggtgaggtccgggccgaagccactggctcgagacggtagtgtaggaggtaccgatgggatcgggactgttgcaagtgaggtagggctgaggcagcgggctcgaggccgtgacgtaggaggcgtcagtggggtcgggacgccaagaaggaggatgtacggggagcgaggaatgctgggaaggatgcactggggagggaagtggccgccagtcaagaggagacgtcggcaagatggaaaaaagtcgggaaggaggagaacgagaggggattcgtgggaaggagatgagtgcagaatttttttttcttccaatagtctgagggtgttttttagacggactattatcgacggcaatagtcgtcggtaatacagtcggtaaaactccattttacatgctaggatattagcgacggcagttttcgttgctaataccaatccactatcgctaatgctattaattttttaaaaatattaaaatttaatattaaatttttttcaaaatttttaaaataatatttttttcaaaattattagcgacagtaaattattctgtcgctaatgctattaattttttaatattaaagtttaatattaaattttttcctcagttgttttttgaatggttaaaaattattattaaattttattaaatttttgagcttaattaatttatgaaataagttttaattgatttagattagatttaatttaattaggcttgacttaatttgaggttaattgaattttaatatttcaagtaggacttagatttaaagtctgattgaattaggtttgacaggatttcgaattggatttgaattgaatcatggatcaagtcctaattgatttaacttagatttaatttaattaggtttgacttaatttgaggctaattgaattttataattcaagtaagatttgaatttaaagcctaattgaatgaggtttgacaagatttcgaattggatttgaatcagattcgaattggattcgaattgaatcatgaatcaaatcctaattgatttaaatcagatttaatttaattaagtttgacttaatttgagactaattgaattttataatttaagtaggacttggattcaatatcaaattgaattaggtttgacaagatttcgaatcgaatttgaattgaatcatagatcaagttttaattgacttaaattatatttaattaaattagatttgacttaatttgaggttaattagattttataattcaagtaagacttagattcaaagcttaattaaattagatttgacatgattttgaattggattcgaatcggacttgaattagattcaaattgaatcatggatcaagtcctaattaacttaaatcagatttaatttaattaaatttgacttaatttgaggctaattagattttataatctaagtaagacttggattcaaagtttaattgaattaggtttaacagaattttaaattggattcgaattaaatcatggatcaagttttaattgatttaaattagatttaatttaagtaggtatgacttaatttgaggttaattgaattttataatctaagtagaatttagattcaaagcctaattgaattaggtttgacagaatttcaaattaggttcgaatcagatttgaattaaatttaaattaaaaattatttttttaaataatttaaatcagattaaatttgtttagacttaatttaatttgaagataattgaattttacaatctaattaggacttaaatttaaagtctaattgaattaggtttgataggatttcgaattggattcaaattgaacccatattgaaaattattatttttttaattaatttaaatcagattaaatttaattatatttgacttaatttgaagataattgagttttataattcaagtagggcttagattcgaagtctaattgaattagaattgacagaattttgaattgaattagaatcgagttcgaattggattcgaattgaacacaaattgaaattcattttctcctaattgattcaaatcagatttaatttaattaatcttgacttaatttgaagctaattgaattttataatctaagtaggacttagattcaaagcttaattaaattagatttgataggatttcgaattgaatttaaattaaatccaaataattttttaaattattagtgacagaaaagtatcaccattactaattccatcgctaataacattttcaaaaaaaaaaaattagattattatttaaatttttaaaaaaaattattagcgacggcaagattttcgtcgttaataatctcaattcaccgtcgctaataattattttatgtttcaacattccaaaaaaatttgaaaaatttaaacacttttagtaatgacttttgtcatcgctaataattaaactgccgtcgcatatagtattagtgacggtaatatttttgatcgattttgtgatggctaaaagatattattagtaacaaaatttttttccatcattaataccatcgtagatattcaatattcttgtagtgatagtttgagatacaacatgcctatcatgaagcaacaccgtcggtcgatggtgcactgatagcactgaccacatttgagcacatccttcatcttctgattttgaggtgattcaagctttggatgattttttttttttttgataagaatagcttttggtgattctgtcatgtaaagttatatatctgttttgttctgggtttgtttttgtttccttttgaacgtttgtttttgtttcctttgtgagatgtgagagctcgttcctaccccagagagagagagagagagacctcgctagaacatctaatcggactgataaaatctttctaccatccaaattaacaaggcctaaatgtcattgtgcatctcgagattcttgtgaacatccttcatcatacttctcgagatttatgcgcatagatacgtgatatctacgttatttggtgccccaatactagctatatgtatcgtgctatgtaaacaagtacatacgtacaaataatatatttttttttcttcacatcatgcccaatattgcagtactaaagtttacgtgatttatccattgtttaatactgaagtaattttgtcaaagttatgaactgaacaaagaattaaatattatatgcagagagatgaaagtaattattaagtcttcatgcatttgcactgatggagatttctagtcggccgaggacagccactgcattatgtctcaaatcctttagatatgcatgattccattgcaggacatgagattaattgtttcccgtgaattggatagagcggataaccctgcacaacggcagctggtctgccatggaagagacaaacagtagtgggtgaaggaaagtttaggagctagctaggaagttggaaactttgaactcatgggattccatggtccaggccactgatagctaattcaataatatcaaaggattcggattccatacacaaggatacaagtactaaggacactctccttcctcggtaacctactccctctttcagtctttctccctggttccagacatttatgattgggtgaatagaagccagagaaaaatggagtgaaactctatatcaaacaacggaaagaagtagctttaatttcccttctgcgatctctgttaattttttaaagtatcggaggtagaagaaggtggcgatagggacggaacatggtacgggtggggctccgattccaactccaaggggggaaggatgtctcaaatggtggacgaagacagacggagtcttttatctttcctctttgggttcgacacgtgtcgctcatgcactatattaaattttctgatgtgaccctgtccatgccacctttgggctttcatgttgtggatttaagtgcttgtttataaaataatgaataaataaataaaagtgtttgctctacgtggaggtatggggtagactaataatgtgggagactggaacgttgacctcggggaaaatgatagatatcctgccaacagctacaggccaaatagtttgacagcacttccaaagtttccaaagcaagcttgtaccgtaaggggttcaatggggtcggacgaagattgtataaaaaattttaccaatcttaatctagactcaaaaaaaactctgagttatatattacacagataaaaaattccaaaactttgttattaaatagataataccatctcatcatcttcataattcgttcactaaacaggttaaatcaaactaaacaagttacgtagctttggaatgggttaaatggatttaaaataagttaaatgaattatattaaattggattgagatgagttaaatagatttcaaattaattaaatcgctcgtaaatgagttaaatatgggttgtgaatcggttcaattattaaataatcacaaacaagttgaatggattgatcagagatctaaacttgaacttgatatagatcgcaaataagttgatttgtttgtaattaacttgaactaatgtattctgagttaaacttgattaaaatatctcagctatggcactggtcgtaacttaccacctctaattattttatacttaatcttattttttaaccgattattgttctgtaggaaccataaagaagttacttgcgcgctacatgagacctttagaaatgttaaaatattaatattctatctcaacctaaccaacacgatatcatgttaggtcattaagaatatatattaggatgttttcctttcacctgatatcaatttttggaatgatcaaattgtctgatttgattatcctagacaaggcaatagcatatttataattgatattaataatacaataagtatatattttactatagttggtaatactaaaattatcataatctataattcaaatatcagtagagtgtgataatttatacagtcctataatataaaatatctaaaataatatcatattattttattttctggtaatattattagtttaaaatatattaaagtcgtaacaattattggtgtggcgctattacatcatatttaagtttttattgtaatataaaatacattattattgaaatattgataaaaatatggtattatataatatgttgcattgtcgtataatagtaaaaaatatattttccttatatatacatatagtaaaagcttctttttattattactcaaccatatataccactaacaagaaaaatgatatccaaactcgtcagatgtcgttttatatatcccattttatgagaatcctgctcacggtggaataagcattctcatgccaaaatgagccaaataaacataataatgggttagaaagggcatctatatccatttctgacatggaaatcggtgaaggtggtaacaaatatagtatgaatgttagccatagctctcttgaaaataacttcagatgtaacgattcaacctttgttggtcttgagttgtctatccttagctcatccttggttggataggataagatcagttgcaacatcgacaaagctcggtgcctctgacatcactttcattttttgtttgctatatatcttttaaaaataaaattttattatttgtaaaaaatgaaaatcagaaatttttatttttgatgtttataaaaataacaaactcattacttttaatattttaaaaataaaaaaatatattttttttactatcatgataataacaccatcttcaccgccttagatgcttttgctattgtctatcaatatttttgtccagctatcttagccacatcattgctatcctttttttttttttctttatgagtgaaagggaagcagaagacctgccatctgattattattgattgaatatatacaaaaacaagaagaagttcaaaatagactatagtaaaaaaaaagctaaacaaacaaaaattggacagacaaacagtccaaattgagtttcaaaaaaatgaacgagggtaagattgtcacaccatcactatcattgttgctacatttattgcaatgctagcatcccctcaccaccatcatcatcctcattgctatattgctaccaccatcaccatcatcttcattacattttgaccacccctactatggccatctctatcattactgcatttactacactgccaccatcaatgttgtctttgctaagttgccaatcccttcgctatcatgctacatcctccaaaagacactatttttgccaacaacccctacatcatgtccatcgtatctaccatttatatcatcgtctctaccgctatcactatatttatattttaaaattaattaattatatcaaatatatttatattttaaaaattaaaagtatatattttatttttaaaatttgataaatgaaagtgatgtcaaatgaagtatacatcaggtcccaatgacctaaaccatttggtccgtggttcgccatcatgtaacaaggccccaactctagtcatagtccgtggctaccatatttggcaatccaaattaacgtagcttttttatgtaaagcctgttaacataatcggctggcccaatttgcccacttgctagcgaggggggcaatttctgacatggcaatctcgccatcttgttccaatttgcccaacaaagaaaggaattggcaacttgggttggatttggttttccaattgggtgagttattttatttataaatcggtaagatatgtatgtatacattcgaaatggttgtgggtttagaacttgccatgcataattcatggtcaagccaaaatgggggaaataaaggaaaaaattaaggaaaaggcgaagtgagtggcttgttcagaatctgtcatgttttcttctatacttcaatgacacattgtcttcccactcctttctttcagtttccccggacaactataccttcaatccccttttcctggcccttcttcatctttactttaagatgtgaatgttaactaattgtgtacatatctccatataaaataaacgagctgggtatggtatcattctttgcaactcaattataaatagcttaggtatgaattaaagtttttgtttgactagagctctctcttttttcttttcaaaaaaaataaaaaaggaaaattgtaatctcaggccgggcctatcttatggagcccgggtcggaatgaagcccaaggacctcatatttatgtctagatttccacccaaccgtgaaactaggccacgctagtttggggcctggggaatctgaaatttttagacctcaaaatcgtgcctcagtccagatgaatggttttacttcttttttcttcttctttggtaaactttaatttcttcttgttttttgaagatgtagctgacaggaatagtggcatgacattgtagctaacacttttctcaaaaacgggaaaataagaaaagaaaggaaaaggaaattaaaggctacatgaaaggagatggtagagcttgccattgaatccaacaccagacaactcttttataaaataaataagaattacgaccaatgttttggataggaaatggagatcgatggtgatgacaaaattatgaatcaaactcttttataaaataaataagaattacgaccaaatgtttttgataggaaatggagatcgatggtgatgacaaaattatgaatcaatccattcgatgcacacaaaaaaattatgcacagaataaatcattgtctaatctcaaaattaagaagactaatgctaaaaggtcatttatcattttagtttatttccaatcttgaagtttatctgatgcataacttttgccaggagtcctaacagagcaatatatcacttcgagttggcctttgggtagcatagaagacatcccatcttgaaattttttaacaataacaataatatttgttgggtggatgtctgaccaaaacaccacctctcaagatctttccagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactgctcgaactatcttagacatatctttaaaaattaatttgaaataaatgctaacttaaaatttatttggcaggtcatatgtttaatccaaataggtttaggtttttctataactaaggaatcgctatacatataaactctggagaacttgagactccttttatccataaaatcacaaaaatgctaaaaatctgacaagttttctcccgcattccttttacttatggagtttcctaaaagtgtagcaatattagacttatttttttaattgaagttaagcatgacttaaatcagtaaaaaagttattattgaataaattaaaaattaaaaaataataatcactttttctttcaccaatcatcagagagattttttttttggtacaaacgaacggtcataccaatctagtgtaagaacatttcaaagagtcaaaatacaaaatatcttctaaagtccgagggcagacgtcatcttgacatcaagtccagtctccagtatgctctgcaacaaagaaagcaatcaagtccgcagtactattagctttccagtaaacatgctgaacatcatctcgatggagtgatgaagggaccttcagatatcgtagagaagtggatgaacatccagatacttcatctcatcctaaattcagtcaatgactggagtggagtcaccctcaatgaagatcttttcagcccacaactcctgtctcgtatagatgatgcctgccaaagcggcacgatcgaagctcaacactggggatggtcggctcaaagagctgtgagccccccatcaccaaaagtctagtattcgggctccggatgacatagcccaaaccatcattgcgatctctgacactgccatcaaagttgacattgacagattcggaggaaggtggctctcaggaaatgaaagaacccttcgagtcattgtaggtgcagcaagagaatcctaaaaacttgaggcagcaaggctcggaccagcagtgtcgaagtgacagcactatatagctaagcaacaggctctttacagtacccattgaatcgatataatctcagtatcaaacaaaaggctattgttggacagccaaacctgataagtgacatacaccatcctactacccccgggcgaacccttgccatgctccgatggatcatgtctaagaagggaggaagctaagggccactgattccctccacggctagccccttactatcctccaaatcaaagtcaccctcggatagcaaaggagagcatgctccgttgactcctcctccagcccgcaaactaggtagataattagaacctccatacctctatctttgagaaatatccgagtcgggagttggtcctaagcaaccttctagagaaaaagcctaaacctgggatgggcaaccattctctaaatccaagctatgttgatcctactatctggcactggtctgcttatatcgatgaggtccctggcaggagctatagagtagcaagactgcccccataccctcaagtcctagctccaatagacaagaattgggatggcaaaaatcatgtcagtttgttgctcgccaaataggtgggtaacctcctgagccctccaactcctgtcgtcaatagtgatcgaattataaacccacagatggttgtccacctctgcgctgacgtaggttggccaatgagagagaggcaaactagagatcccagcatcctggctcacatcaatcgagattctgtctccaatcagctacttgatctgagctaccactgtaggggtgcatgcacatatctttttccatatgaatgagtagctataatcaatatggatgtggggctccagactctaagctccataacaaactaccatcatcctgcttcacaaacaatcagactgaaagagaaatctagctagctgtatgtctgaaaatcatagcctctctcctgactagcaaggattggattctaagaccctcatcccgcaccggctgacagaccacatcccaagaaagcaagtgaagcctatagccccatgtccaatttcccacaaaaaattttgaaactgctacttcagacccctaagagaagaatatggcatcatagtattcaccaagaaatagatcagaatagaacttagaaccaatcttacaaggatattcttgcccatcatgaagagagcgttggcttgccagccatcgaagcgatctcagacttgctgctctatatgcctgtagtcggtccttcgaagtctccttctgtgatagggacccccaaataggtcaagatctctatctgctcagagattctcaatctgtcctgaattgcctacttcacctggaccctcatcttagggctaaagaccacagtggacttctgtagattcacatgctggttagaaagcttgatattaggcctcaacaatagttgcaaagcaccttgcatttcgaactgaaatctgactaatgagcaagcagtcatctgtaaaaggaaagtgtaagagtggctgactcccaagattaggccagtagggctctagctctgtcctttggaccgttgccccaagagtacgggagagagcattagtatatataataaaaagatagggggagagagggcacccttggcgaaaactgcccattgaatgaaaaaagtccatgggggcgccattgattaggatggcaaagcttgggatcttcacacaatccatgacctggccgatccatttatcttagaagccaaactcatggagtgtttgatgtaggaactgccagcttatccaacataggtccgctccatatccagcttgatcgtcattaagctctgacgaatgggtgcatgtcgcatatcatgcataaacttctggatgagcaagtattgataaaaaatacagcccaagagagagggtgaattgggttttcaaaaatttttactaacttaaaaaaatatattctctatttgaatgagctaattatgtatgcagtagaagtaatgaacgtatgaatgaaaatttaaaccaataaagtaagaaactaggaagcaaaatcataaagtcataaacattcaagtttatagtggttcaatgttaagctcgatacctacatccactctccaagtaatccttttgagaattattactataattacttgattatagtaagattatttttcagatttacaatcttaacccaattgattttgtgggcttactaactaaaatctatccccaagccactcttagatttgtacaaattcaattttaggctaggatgagccttttcctcaagtttcaatctcaattgaaacttgtaatatagaaatttgaatataaaaatatttaacaaaaacttaagcctcttaatgagctgatgatatgtcgttgatgcattagttgaggagttgggaggattttgcaatgaatgctctcttcttcctcttgagaaatacttgattacataagaaggctggtggttgcagttgaaaacctctttttggtagctcacttaagcctcaacaaaatttttaaagtatattgtggttttctcttatgttctcttgattttcttaagtttttttactttaataatggctcagacacatattaaatcaagttaggattactaagaatgggtttgtaacctttaaaacttgaaaaaaaattgtttggagatttctgtgcaaaattgcagctttctgaagactagccattggagttgtcaagaactatggagtcgacttgagcagatttggagttgactcaagatcttcgagagtcgatttgagcactatatccagaaaactacctctctatcttttctaagagagtcgacttgagatgtgctggagtcgactcgagtctgtatcagtgccatcctacataccggagtcgactcgaagtctgcttgagtcgaccctaaacctgtgccaaatattgaatttgtactaaagttgactccaatccttttattcttaaaaaatataaggcttggcctcttaactcttccttctttgattcttcaaaatcgaaatcttgaatatctttgaaataagattttagctttttgaaatttcttctcaaatacttaagaactttactaatatcaattttacactcaaatgttttgctattcattaaaatcaaacctaagatcgacagtaagatattaacaatgatgcaatggctactaacaaaatcaccctgctcccgactgatcatgtaaggaacaaccaactttcgatgcccgatcaaaattctcgcacacactttatagatagtggtacaaaagttgatcggtcggaagtaatgtggggttgatgcatcatctctcttcgaaatgagtatgatcatcatcttcttccactcctttaggatgcctctagattcaaagactatctgcaccgcctcaaccatttcaccatcgataatagcctagtaccatcgaaaaaaaagaagggggaagccattaggccccagagccttatcctcctcaaaagaccagagggcctctcgtacctcctcagtagacacagggcgagttagaatctcattcccctcctcaaaaatgtggcaaacaagctaggacccctggaagggggcatcttcgctcaagagggcagtccaacgtgatttaaagaaatacataatctatctcctaatctcataataccctccaccattctaccaatgctctccctcagctgtctgacgaaattggtagactttcgaattatcgtcaactgagaaaagaatctgatgttccaatcgtcctccttgatccactgtaccctagacttctatcttcatattgtctcctgttgtctcaacagagtagcttatgtcaaagctcccttgggtcaagctcttgaaggccccctccttatcttctctcctttggagcttcgtaatgttcgtctttacccccttgatctacttgaagatatcaccaaccttcagtcggttccatcagatatgcctgcgccgcgcaaactcgagccttctgattatatctcgcattaccacggatcaacatccttcaaacatccctaatcagatctaggatttcggatagaaggtccaaaacttatcggatagaaagtccaaaacttttcaaacctgaaccgagctctaggcaagcatgggccctcagtggtgatgagaagtgggcaacggttcgaagcaatgctcggaaggtgctgcacctggtgttagaaatcaggcaacaatggccaacgctcgatcaatcctctcccaaattctagctgtcccaagccagttgttgcaccaattgtaaatctggatctagtgtagccaaggtcaatcaggcccaagtctccattgaaatccctgaactctctagaattaatactatccacatactgcttgccacccatcttctcatgggactccactatatagttgaaatccctagcgataagagaaagtaggccctgcgccaccattctgaaaattttgggctatagcaccctccgctccctgtacttggtgctcgcatatcctccggacagaagccaaagaccatcagtttgctcagatatgactaacgccacctgttgctcatatctgtagaaggcatcttccttgatcgagttacgatgccaccgcaccatgatcctcccaaacagactcttggactctacagcgtaggagctccacactaacggaatccattttttggctcgcctgcatcaaagtcattgggccttgcctgtttgagctggcctaagcccaaccagcttgcccacccacaaccccttcgtccatctgtggcccatctggtccatgcaccacgaaggccctaacgcttgtgaacgggctgatagctgcatcccaacccagcgctggcaggccaaacttgttgacgggtcggatcgcatacgtgccttcgcctacatagatctccatgcctatacaaccctccgtagccccttccttcgatttggctgttgattcgggtctgaatccgagcggcgattcccgtcatgtgatcttggatggcttcgtccagccatcaaatccggacagcatgtcaactaagatcgaatcatctcgaatccattattttttgaatcgattcgacttgagatacgactaggtgcctcgttgactcggccccttcttccccaaagcgcccaagatattttttttttttgtttttaaacttgttttgcgaaaatgaaatttcgtcggttagacatccgcctctcgcaagttattccgtcccgcaattcgcccagacatcccgtatgtcgttgacgccgttgcagactccgggaggtgtctccaacatcccgtcttgagctctaatccctgctgctctcttcgcttcgaacctttacaccctccccgccacccccccccaaaaaaaaacacactcgacgtctccctgaagccctgacccagtcctctcgagagccatctccaatggcgaacgaggagcagaagaaagaaggcagggaagaagaggagcaggtggtgaacccgtgggaggtcaccgccaaggacggcggcaagatcgactacgacaaactgatcgagaaattcggctgccagcggctcgaacgctccctcgtcgaccgcgtcgagcgcctcactggccgccccgcccacgtcttcctccgccgcggcgtcttcttcgcccacagatccctctcccgtcaaaaagatgtcatctttttgctttctctttacgtttgggtcgtggcattgagtgatatgcgcctggattgctgtctgttagggatttcaatgagatacttgatgtgtacgagagggtggagaagttttatctgtatacggggagggggccgtcgtcggaggctttgcatctcggtcatctagttcccttcatgttcacgaagtaagctttcatctcacttggctctctggttgttcttgaattcgtcaatagtttgtatatgagttaaattctgctatactttcatcatgttctgattttgatttttttgtggttggttggtgtcgaattacaatctttagatgtgtcagtataaaatttcctgattgcaagttggagttaaacttgctcgcaattcacagtcttgaaaatcatgtattttacaccaagcctttgttccatattggtttgataactatattattaaatgataaaatagtgtcaagaaataacagtttatcatgtggatcatgccaaaaattttgttggtactatctttctcttcattcagtcaaattctattttcattactctaggggtgcattccatttgagtctcaaaggtacaagtttcttcatttgtttgatcctggtttgtttcctttcttattctgtgaactctaaacccaatcaagagaattttctgtacaccttgaccataaatgttgtttgggacttttttgatggtagtcattttcttgttgcgtggacataaatttatggttccctcctgggttcttgggcttgcatgtgatttgggctacttggacattgtggaataattgggtacttgaatacttaacaacatggtttctctggacaatttatatcgaataccaaggcaaatgtatccttctaatgtctcaaatttcagcaaaagtgttaggattgacattacctttaggtttttctaattattaatctatctcacacttaatttaaatggcatgcacaattcaggcttttgtatatgtaaaatatcgatatttttaatttgttccatcagcccctttttatgtgcttatttttttaagcacctccacctgtatcacatgtctaggttacaatggccttaaatgcattctaacttgaagaattgaactggactcccattggtaagcaagaaaaaaagaaagaattagactacatgcgttgttttccttttgtcaacttgtggttaggaaatttcaactttcttgccatatgccttcttgatgctctcgagtaaaacctagtttttttcgtcctttgaccttgatcaacatgtaagcttggtagagtcattaatttttctcctggataatctgatctgatgggtgataagccagcgactctttccggtctgcaagcacgattggttgggttaagccacttttctatgggctatttgttcacttatgcagcaacctctaccttaggaaaaatctgttaatttttcattaccattgatgaaggcatttttgctgggatgtctgaaaaccagtcgtacaatgtttgcttaaaggttccatttaaagaacttcataaataatttacttcttttttttttttgtagtatggcagctctccctaaaatgagggctgtgaagttacatacatatgctttgtttgattaaggatcttattgtgtaagaggtcaagtgttaggtcacttcaatctttataaggtttcaaaaattgaatcctagaactccatcatggacaacaaaagcaccccttgtgaacagacttgataattgcttctttttcttctctgagaaaggtttagtaaaccaaaagcacctcattgtctgcgtgcttaagtgaattatgtgatgtgaggtattgtggattgtcaataaatgctcgtagaaacaaaaatgagcaattaccttttccggtttctttgtatctgcaagtaacattctctcaacattcaacaaatatatgatccttgtaatccttctcgattgaagcatgaaaaaagattgaatttgagttggcttcactagcatcttatagctttctgattcattacatgtttttttattggttttacttggatttgtttcttttactttctttctctatcaatatggtgctaatttctatgtaggataaagttgcacttacattaaagccacagaaccaagactgagcttattattggattttctcattctatctcttgaattggacctaagcttcattagaagcccattcctgtggtggtatatgttggctgcactgaatttttaggcatgatgataaaccaaaattttcaagccttgcacttatcatcctagatcaatttaataaatctattttcaccaatcattcctttaatgggcttcctccattgtcacttctagttctttcaaatacttattgacattggcttaatttgtgtatagagaatttgttgaaaaacatttctgacattaaattagacttattgaaaaagataatatgcatatttctataatacatcatctgcagtcctagcttggatcgtgccccggtccagccaatttacttaatcatgcttggcttgtgcggaacttgtcctagaaaaattttgtcggtgaaaccttttgttttttttctgactctgcatagtgtgcatggtgtgcatttcaccagcttgacattatcttctgtaagttctctagatttatatattttctaggaaaagctaagtcagtaatgtagtaataggttgttccttatgatttttgcagatatttgcaggatgcttttaaggttcctcttgtaatacagctaactgatgatgagaagtgcatgtggaagaatctctcagtagaagagagtaaaatgcttgctcatgagaatgcgaaagacataattgcatgtggctttgacataacaagaactttcattttctcagattttaattatgttggtgggtaagttatagttgagtgttgtcctttcacttgcatgaatagatatgccaatatctagtggcataacaagaacaatgttgttattgaggtcatgtttgacaggttttgtgctgcacctgtttgattctgtttcatgttttttcttagtttattagatttcactctggagcattaatatgcatagatactttgcttgtatacataaaagctcagcaatcattatgctgaatattctaattggttgacctcaaggtcacttaaattccatttgcatagtggatgttgtttagttattcctaccattggagattgacatttttgctatatttatttatatacaaaaagacaggttgtaaattctcaaaaatatgattggtaaatgctggtgatgggcattgaactcgataggttgccatactctttatgttatcatcatcatcatcattgctaatattatttttttggttttcaacttcgccagcgtggtaacacacgtatgaagtttagagatgatgttgagctcatcaggtagacataatgaaccaccgatttttaagacagaataaaatgaatgaggaattgctggctgcggaagagtcgcatcacaactatgcatattcatccataaaactttcatgtgacactgaatttaactctcattcaatggattaatctcctgatgcttcggatttttgttgcagtgccttttatgaaaacatggtcaaggttgcaaagtgcatcacgtttaataaggtaaatgctagagtcatttgagataaattccaattttatgtgggataagtttttcttgttatagtactgttttcttatgtcttgcatttgtgtaacttaggttgtgggaatatttggcttcacacaagaagatcatattggaaaaattagcttcccgcctgtgcaggttcagttaaaaatactgttaaaaatgcttataaattttcagttattttagctttctagtctatatgtacaaggcttcgtgtgtgtgtccctgacttgtgcttttctctaacattatctgcattggcagtttagaaagaactgcttcatcttaatatcatacataaattctttatctgtaggaagtcccatcgttccctagttcatttccacatctcttccctggaaaggaccagcttcgttgcttgataccatgtgccattgaccaggtgccaatttcttaatatttaatactttgttttgatttaaacatgcatatgctctatagtaaagattgacatatccccactaattaggttattgttcacccggatatctattttggcacaagtttagtgactggttacctgaacacatggcacatggccaagatgtcttgaagattctgacttaaatatttaagaaccaagcttggtgcatccttttctatttatgtgttgtgtaagtatgtatagattatcaattgatgagtggttcagtttggtttctgttctataccttgcatgtgcaagcatgtgcagttgatcaacttatccatcttcttgttagtcaaatatgtcagaattctgtgacttctatatatagcttcattgtgtttattcaaatgatgatgtacaatttgatagtttggcttcctcacgtttcaatagtataaacaagacccttcatataatattaggtttggcaccattcactatgtggggaaataaggttataagatcaataactattagaagttccaaaaactgacatgaaaggtgatgctgtaattggttttacaacacatcttgtcaagcagtgccgtgtcatttcatccagtattaaaacattgaattgtcaggatacttcaaatttcctcattttcaaagtgtccacttgtcgctttgtagatcaaatttcctagttgaattttcttaagtggggtttaggaaggactggtgaacatactgataactgatctgctattatattaactgtgcatgaaaattttggcacaagtatccatgttatctgttgaaaagaggtggtgcttctggtaataagcccttcgcagggacatgatcaaaatctggaacttctttgcttgtccatttgtatgataagcaaccaggagttgtgaacaaacttagagaatgtgaagacaccagatttgaaattttgaatgacattttgacagtctagtttgtacaaaatgaagtcaccacatatgggtgtatcacctgtatctaatagttgatcattatagcttgacttcttgatccactttctgattgtttagtaaccaattgtgtagaaactctgaggatacgttgctgatgcatcttaattttgactacaattttgcttatcatactttacagcttgtggtcatcattaaacctcaacaagatgttccaatggcttttagaaaccagatgttttggtttagattaatattttaatggtctagttggtgggctttgatttagtggatggagaagtgatgcacctctgttcaacttaatatttgaggttttcatttggtcctgaagagcttaggtagcctttgtgggaactattagatgctccatccatcatatatgcataatttgccttgcatgctagtttgttggtgttccatggttccaccggtatgtgctttttaaaagcattctttgatagtcccagcattagccgaaccatcttgaaccggacaatttaaggcattgtgagccatactggtagcaaactgaaatggtttagacggataaatcaaaacaccagatgagagagagggaaagagaggaagagagagagagaagaggggagaggaagataggacgacgctgttggaggccagcggtggcccgtcgaggttggccggagggccacgttggcctctgcagcttgatgtcgcctgatagggcatttaaacaagagagaaagagagagagaggggaagcgacggtaccggagggatgtgcagctggcggagaggttgtcagagggcaccagatgactgccgtggtcatcggacggcgaaaaatatccggacggagccgtggctgtggaataggggcgaccgcccctattccctcatcgcatctttttttaaaatgccgatgaatggtgaagcaggtaatggatttgctggcttcaccataatcaggattttttagaaaaaccgatgaaatagggacgatcgcccttatttcatgtccgcggtaccataggcgtcgattgtgtcgtccgacggccacggtggtcagtcagagacccttaggcagcctctccggtggcttcccctcttcccttttctttctttcctccctctctgtctctctctctctcttcctccttggttcccttctcctctgtatcggttcacggcagtacgagccatccagtccgatacggctctgtaccggccataccgtcggctggccagcacaggtcccgattttgattccggttctgccttccttgtttgatactattgtgccaatggaggaattatgagttgtatgggaaggattgactttatgctatgcacaagatgagagcttctcacatttatttagagggagactcctttctagttgttagatggctttcagatccacctggtgctgatgccagaattcatctacttttacatgattgctggtggatgatgcgtgccttgctctttattgaggtatcatatatttacagggaagctaagagtgctgctgattggatgacgagctgtgtaaccagtcacactgggactacattatggggttcttcaacaagtcttccttctcaatcattgaatattttgttttccgatccctgcagatgtatgtatacttatattaattaatttatctgacttaccaaaaaaaagaattctttgatgcctttattgaaatcatcagtcatttgcacccttcttcaatcaaattcatcatctctgtaaattgattcttgcattgatgctgtttatgaaaatctctgctgattggtactagcttcgtgatctttctattgttgttttcttttgaacagcagaaagccatgttttattagcaaactcaacctctaaaattagaactgtgtaagaacacattttagagatcaaatacacaatgcaatttaattttctagtaattttacaattcacagtgggagcaaatgtagtttcagtattgttcctgctttgttcattatcacttcatgataggttctcatgttgctgctaccaccaagcaactgcagatgtctgacatacaaggcctgttcagttctgcttgaataatttctactttgttcactctgtgtctgagttagggtgatgaatattttgttggtgttagtgtggaatttgcctacgtgcacttttcttttcttttttttttgtatccgaggatagtcaagtgtgctattatagctgttttttgccagtctattttgtatatcatgtcttttgttgctgttaagcaattcttgtttaccttataatgttattcatgatacaaagctttctgttagtgactgcatgaaatttgatatcaaagactggaagctataactgtatacaaagtaaatttagacctttgtaaacagagatttgtagtctttagttacatttttaatagcaaatacatggaaacaaattttttattcatctcagatgtgcatataggttggcgacatgatgcgctattctctttctttgttgttttgtcacatgtcttggtatgactagttccagatcaatatttccctctctgctttctggttatttgatttgcttgtagttttacctgatctttaattattttcttgctccataattatgttttgcttgaaatgttccaaccttttcccttgtattctatgatattagcctcatttagctgtttctgactggtttccacaacccaaccatgtttcacctttcatttcaggatccttacttcagaatgacacgagatgttgctcccaggataggataccaaaaaccggctttaattgaatcatcattcttctctgctcttcaggtatttaagtgaaatgtgtttacaatagaagttgaacaatactgtaatatgataggtaaatagaaagggtaaattcatgatttgattttatctctatttgaagttgtatttttggttcaattttgaaaacgattaacacttgttatctgtcaaatgttatggatctattgtgtttgcaaatatgctagtcttgtacaactactctattgtaaacaaagagagttacagatgttgctagctgatgaggggaaaataacagtaagaataagaagaaagagagctcagaatctatcaccaaaatgaaacatatggcttgcaccaaataatcttttgtgaaatccatcagctataaaggacactggggccctgagcaagcatttaactgtataacaagttttcttctttattttgtagatcaagtagaattacattcatgacttaacaagtttaataaatacatacaatttctatttttttgggtcataaccctagtagactcggatggactgctaaaacaaagaagatagcagtcttgaaacaagtaggtcctatcatttcatcattctgtatttccacttttttgcattaatttaattgagccttgtgtcagcattataaagtagcattgttttaactttgaaccatgtacctctcttcgttagaacttcagttggtctaattctaagctctctctctctctctctctctctctgtgacaagcttcttcatatggcacatgcatggcacaggcaatcttcaaagtcttccagacatgtttactccttcaaattatgttccatgaattttgctgttggttaaagttcaccaaaattacaacttaaacaactagtgaaggcgaaatattatctcttcaaggtttaaattcttgtcatttcttatgatttcaaagcaagaagtgcctgttcgtgtcatatgcaacatttttcaaaattttcagtgtgcctacttgttaggaaaataaattcaggagctttattgatgcatgggtgacacatgaatctgggaagaaggaacatgctttatataatgcacagaaaggtcaaatttataaaatggggcatcaggggatcaatttgttggatccatgacaattgtgcaagatttaatgatttatgcttaacgtgatactaccacaagatatgtgcgttgatgtgccacatcccttatcaatgttccacatgcattacctgctcgactaggtaagcactatgccatgacaaatggtcagcagtactctgtgacactcagtgagatctgactttatcagctcatacggagtggattgcagaactagggaatgagatctatagtaaataaataattttctctacatgttcatctaaacacaagtaaaagaaaatgagtagctatataaacacatgaaaatcatagtgcttgtcgaatgagactatgctgtttgcaatccactctccatctatcaaccttcttgattttcttgtagacgactacttaaatttttcactttaccattttgagtatgttccatttaactgcatagtttcctatggatcagtcattcatgtctattcgtttcctgaacctgaatatgaacagggggagacaggaaggatgtcagcaagtgatccaaattctgcaatatatgtgacagattcctccaaagacataaaaaataaggtttgtcttctatgtagcatcccaatttttatatttctttatgtgtgttatgttccaatgtttattaaaaattaaggtgtaatttgctttggtaatcctgaatgttaactggacattttcctctagttgaagttttacttcccattggttccaagtctaggatcaatatctttttctttacttttgttttttgatcaagtgtgatatttcatgagaactcctatggttctggtatgctttttctgattgtcggtataaggtcagagtaggatactgtttagcgtatggagaatcctttatactggatgtttaaaagaatcctctacactggatatttgactagcaatggaaacagattgtattgcgctagtaaatttttgacttcctcagtgcttttggaaaattgatctaagagaaactgtagtcaatggagttttcagtacattccaggtttttcttctcacatttgagcaggttgattttttccaatgtataatttttttttttgcaaggctatgattttgctcatgagtttctctaaaatactttagtcaatggcggatgttcagttttagaacaaaagacaggtgccaacagtgacatgccaatgtaatcaagaattgagctgaatcagttcatctgtcactaacatatagtggttaccacagatcagctaagctttttcctgtcccacatcttacagaagaatactgtgtttatagaagaatactgtgtttttatggctgattttgaaaagctttgggtcatggccttaattacacacaatgcttcaactgctttgtcatttattttataatgtgttaaaatagaatttggctgtttatagagttctgaggtcctcactcctttttttcttgaaacacatatcttagttgtcctcattgagtctcctcatctcaatagaatttccatctcaatttctcctctgtcgacgtaataatgtattcattttaaactcttcttttgtttgtgttcttcacaacctattcaacaatttcttctttaccatttttctctttgctaggaaccttttcacattctaatttatagtattatttaacaacgatgcattccttgccttctaaagtccaggaggcatgtaatggggtcctctacttggctgcatatggctgagacctggaattccagcacatataataatatatatgatttcaaggcatttctggtggtttagacccataccagtatggatgttctgaaattagtttttgaatcatgaaattctttaccaaagaaataatctttctccccactccccgttcccaactgatcaattatgacctaccaaaatgacatctgtagcaggttttctagagattggtgaaggatgttctgccagaaggatgttggtattgacaataaattaacaaaatgccatgtttgcatcctgaagctaatgtgggagtctggatgggaaatatgtgtaaggaactaccaaaataatccattcaatatcaaaaaaataaatatataaaagatagaaatataatttagctaattgttttaccctgtgtgcccctgctgctctctctttttacgtattgggaagttgcatggtcaagactcaaattcatgtccaaatcttgattctttcatcagcttccatgcaacaccatggtaaccctgagaatctgaaagcaatccagtttttggatgagctacactgcaaggccgataaggaagagggaatttgaggttttaaaccattttttgggcatatatgtttcgcttattcgtattaatgttggtctttcattctgaagcaattataaccatttccatggttatgtttctttttccagtcttatacaagtgactggggttttgtttgttaaaatttgtgagaagttgagaacttttgtgaatttggattgtatttaaaattgttaaccaaaaaagttaggccattatttagattgagctggtatgtttatagacaggatagatgggcaggtttgcctggagcatctgacctgctcttggctgtcggtagaatgacaacttttgatgggtctggttgtgtccaggtcaacctttgtgaaagctgaactagcccagcctgaccctttgcaaaccttatgtgcatgtcttgaatgagcatgtatggtatctgcaaatcctaaccaaaaaggcattatttgtactgatactttttctttgtaggtgaatagatatgctttttctggtggccaagattctatagagaaccacaggaaatatggagccaacctagaggtatggtgtcttctctattttttttgttatgtgtgttaaccttgtaaatgtcataacccttgcaaatatatggcatgagagataattttagtagttcattttactatattgatacttagcagatttaagtgctgatgcagttttttcaaaatttttagtggaaagttccttaatattttaaacataaaatataattttatattcatctctctgattgaagtcgttgaccttttaatgtcctcctccttttgttaacttcctccactgtgggtaagttatacatgaataacctacttgtctatctaaaaagggtcttgaaaaaattgattttgctatagcggaatgtgatggagaagtatttcttgtcatcttccatttagactgaagagtcacgtgataccccttggtgcatgaaaatgatgactccctactttcttgaaagatggagaagcatcttctatcaccgatactaaaacaggtttatatattttagtttatatttattcataagaaaaaaatgaaaaacattcatgagaaccaatttacatttctattctacttttgatttttgtcaaatcttctcattgaacttgaattttcatgtgatgtttgtacatggactctttcacattcttgttttatctcttccttcttgccccagtgcaggtactttgttggcacctcccattctctaattcacattttgtttaaatttaagccagaatgagattcatgactaacaattctagatttttttttcccagatggtggatgctttcatggctgtcagacctctacccaatatgttcagctaaatagcttttgacatacagatttcaactcaattcctctcaaggattaaaatgatcaaacagcagactttttctgctttactgattatcactgaacgaattgttgtactacctccatctatatcacaaccaaagataaggaaatcatgtctatagaaatgggatttcgggaggataccgaatttatttgtcctgcataagttttggcaggaaatcttattggaaaattgttcttgtttgaaagagggcccagagtaatttaattttttctactctttcgattgacactcaaaatactttttggtgttacacaagtattcctgttctccagcttgtttgccattgtgctgaaacagttgtaagtttgaacagtggtaatctgcatggataaaacataaactgatagtcacttaaaaattggagtatttctcattatttggatgctgtaactgttggattgcatgaaccagattcctgtatgtgccatgtaagtggaaggaagcatggatggcattgatcctcttatctgatcagtttttttcttttacttatgtggcttggtgaatgctcttacatcttggtgtctgtaattcattattgtgccctgaaggaaataaatttggtgtaatatgaaatctggacacatgatgacatctgcaaccacgaccattcatatgtaagagattttttttttcttttttctttttttttttcatgtaacagtgcttcatagcaggactgatgggattgtgaatggctgtgattctcctgtaaatgaaaaatattttaaattgttttatcatacttgattaacatctaatttgatagagaggggagtcaatattgcaggtgagaaatgcgtagcatagaggagaggtaaagagtatccagatttctttcccctaaatatgattagagaaatataatttgaagatatctgttcgctgtacctgtttggtaactggtcgctgggtgtaagtgaatcccagttgcagttttccacacgcattctcagccattttcttacagggtatcagttgagacacttggattttgtccaaattacgatacttgccatccatctgtgggcttttcaccagctctaattggttgccttgaggaaaaattggatcattctttatacaatgaccggtaaagaaaaataaaaatttattatatataacattttaggaagcactgtagcaaatccctaaccccaaatatgttaaggagggagttgcaattaaccaaacactacctaaaagagcatgtaatgagaccaagaaccatgtatggaatttaatttttgctagcaaatattaaaaaataaaatatttgccagtgagtcccagaaattagaaaacacctagtccacttaaccttttgatctaaatgaaataaccatccttttctatttttcatatttattaaattaaaataatttattttctgaacactagctttactaaaaaataacaatgatagttttttcctcctcccttttttttttttgggccttcttttggatggaaacgacaaaaaggcccataggcaggcagtgagttgtgtgaggggagaggggggagagctaaaaattccaccgctccaagagcggaaaccgtgcacggcgatgggcggcgttcgaggggttctcttggacgaatcgctcctcttctccgatgccggaagcggtaatttctacctccctccgggatccgcaactcttcttcgtaggcttcagtactcgaagcttcgcgtggtatacgaccttccaaaatcctcttctttttgttgtttcatctcttgatttcttaagcccttgacttgtctggcaagaaatggccgtctttgaattctgtttttgggatcaaattttgtggcaatcggtccaaggagccatccttctggcagcttcaatgcatcgctattgattcctctttttctctctccatttttctcttttcagttttcgtagttaggtttctcattcttgatttgatctgtttgaagcaagagaaattgcgtgaatgtttgaatgtataagaaaaaaaagtttccgtgcttttgaattggtttctgaaaatgttgatgatgcttgtactgggaattttagaataggaaaacagtatatatatattcagttctctatgctgcatgttgggtttatctgtcatgtctattttgaattttaaggttgaataattttgtgtagaatgctgttcttttctcctattcctgtagtttctgtattggttttgaacactatcaaaatcattttagaaaacgaagacccaaattttttttgtcctccattctaatttaaacaagtttgtcaatcttccgttcaaagtgttaaagctttggaacaaggtgtctgctgtctatactgtatggtgtttatcaatgattaatttcactggcatgcggtatgatttccttgaatgctagtgtggatggttatccaaataaaagtttatcagttgagtgctgtggcatatcctatcatttgcttgtctgttactctttacctgaaaattggcatggcgtgatcctattcatgaaaagttctaacctctatgtcacacttacttcgcagggtttttgttaccaaaaggatctatcaccacaaaaggtgcatcttgttattctcttagctttattttatttttattttttaacgtatcattatatgattgtttatggaaaaaatgtgagcagttttcttgtttgtatatgtgaggcaattttagaaataattataagttgcacctgcatataagtgtgttattttctagtagattgggcatatctataattttacatgcaatgcaacgagctaatgcttacatcaaaattgactgctggcttgctttgcatctttgttggtcaattggaggattgggcaaatctttgttaattgtttatatgattcaaggtctagggagcagccatccaaaatttctctagatctgaaatgagtctagatagggaatatgaaaaggtttaatgcagaaagctatgtgcatctgattgttgaaaattaaaaatattataagaaatatagcataatacatgggtattggaatttgatctctccaacattaatttaaagtttcaaggcctttgtaatacctgatgctaatcttcagaaaaggggcacaagatgctatgcagtcataataagatttatttgtaattaaatggcatttttaggagtgtgattttcctgttagacttgaatgtattataagaaataaaataaagaaacatggttatgaagaacactgatgatccaatgaatgtcaacagtgaaacattctctcccttgtaatggtaaagttacagtctcttgcaatattcattttgtggaaagaaacaagataagcaatgaatcaagaaaggttctgagtggctgtgccagtcacccaatggcatactatgtgctatgctggcacatgtgccacaccatcccaagacaaaaatgtactgagatgttcttttagttaataaaaataaaaaaatggagttaaatggcattgcaccagcccattccttgtgccagtattggactagcatgatgagtcaagctatattattggcacttatcttgagcaaaagtatcatcggcacttgaaaccatgattctgggcatgttagatttttttattcttttgaaaagaaatcccggactcatattcaaatgaactaggatgcatccatgctctttgtaaaactgcttgatgattttctgttgtacgatatatcacaaaggtagccacacacaacatgatcaaacttatctgataaattcttttgcatcattccacaagggtatgatgagttaaccgttatagaagaactgttttgtttaaaggggtgatggtgttgttgtttctctttagagtatattggctttgtgtttggagtgttgctcaaaattgcgaccaaattgtattggtattggtcataaccaagaaactagggccaactttggagattcagctggaataactcatgaggccagacggtctacaattctaatttatgctcatttattttttaaatgttagacggcagtttctctattcaaattttacatactttgaaaagatatttgaattaatgcaataagctattcaaaataagtcctgcagtgctaaatattaaattcgtaaaatcattggcttgttgtatgctagaatgccatcaaatgccaaaccattgtcacactctgaactgtgattcttgactttttttagtttttaaacaattctgatagattcaaaaccacctatatgacaaatgcagaagtcccaaaacaacatacatactttatagatttattttatttttcgtcgctttttctcttaatttctttttttacatgttttacttagtaattttcaatggccattgttgagactaacttgaaaaccactgaaatcgaaactcattggtttgatggaaatggaaaatgtaattgaattgaaaagactttattggttatgaaaaaagaattaagacatattattttaacactttattgagatcttatgcttggtttatgcaatgaaagtcagtctttgttcgtacccttttctacatcaacaatttctttagtttgtaattcttatacttttgcataaaccaagaggttgttgtgttactaaagctaatgtactgaggatacgtggtgcttttttgtttgatgattattattattattattttaatgttaactctaaggtctggtgagtgatgtatcaatgcctatccattacatgacatgctggcaaggaaaaggatattttgtgcatagttgtcaagatgatgcagaaaattttggcttcaattacttgtttgggggcccagggttgtttagacacattaggtggtcatccagtcaaatagatataataaaacaagttaactctcatgactaggaatgcccgttgaattttgcatgttgtccttctagaactttcacctttttattttttcatagaagcctaaaaaggctttccaagttgacattatttttctgtggataccctttcgggaagtgcatattatcagtttcccaatataataaacgagaagaaaatgtcgccctaaaagctaaacccgtgcaaaatggtgcaaagtaattaaaaaacattttttaaatgcacttaggtttatgtacattttgcatacgtttttctcatttgtgacatcaatgtctttcatagatcactttgggaacttttccaatggtttctttcttgtttcagagttgcttgctgattcctggtcctgttctgaaagtggaaagtacatttttgccatcatctatgttcctaaatcagcgaatatggggttgatgttatgtagttttgtggtgtgccaccattaattactagctgcaagtgaaaaattactaatacttagttaagttttttgtttgtttgatctcttctgtggtattaaattcaaattgttcaaggcctttttgtaatactagataaatatgcagaggaaacaaggatttgtggagcttattagtaataattatgtctatgatttggcctaattgttcggttttctttggacatgtttttatttgtttttgatattgtaagattgcactattattcttaagccttgtaagtatattctcttgttctatgccatgtttcttatgattttagaataaagagccagcattactatttcgagaaacatttggttgatggtttactatgttttgttcatgccaatattttaacaaacctacgttgctgatatcaatttagactggcatactaattttcttgacctttataactgcttgttataggaaatctttcttaaacagacagccggatcatactcctttgattgtatctcattgcatggatcacatgcaaggaattcatttaatgagtcattgccagactggcatgcagctggagagatatgcttttacgtaacttccagaaaagatgaaacacttttctgcaagcttcagaatcatggttggaggattatttgtattggtgagtgtttgtttttgtctagacagggaatcttccatattctaaatatggacctattccttgtgctttcttaagctcataatcaagatatgtggttcattcttgaattaactgagcacttgcagctgttatgtttattttaattggatttcttactacaatctaggtgttgaaaggggtgggacaatggataaggagttgttgtttattgacaagttggaagagttgccaattactatttgcagcttcagcaagaaggttgtttgttctccgggttctacttctgagtcaactttattagggtgattgtttatctgcatagttgatctagtatctccatatgacccatttagaatgtttttattatttgcttcaggtgatgcgctgcacaccagtcctgatggttggctatgttatgaaaccatctcgtgaagaagattttgcaaaggcaagtctgggtttagaactagatgcaggtattatattgaatgctgcggttgcaacttcatttgcatgactacttgttttggacagagaggcgcattccctatgtatcctactcaaaatggattgctttttgttcctctcacatttgaacttcctttggcacctcaaatacaagaagttgatgtaatcctccataaagcaactgatgagatcctcagcattgagccagactactgtttggattttccaaagggaatttatttctccaggggaatgcaagaactagaaaggtgattgccaaaatcaatatatgtgaggatctgatattatgatagttaatgaacgagaagcagttctgttcagttttgctttcacatctgaacatgaaaaagaggtcaacatagtttattttgttttgttatccaagcctctagaatagattttagctgattcaatctgaacaccagtgtgaaggagttggatctatgtttctggatggtaacttgttagtaataggagaagagtagggtaatgagccgtgaacaatagtgcacaagtgagcaacaagggattactctatgtttaaataatcaattttgaattggatctgttgctatgtaggtcaaataagtggtgaataaggtaaaacactaaaaggtataggaaagttatttttgtatcagatctgaattagatccaaaaacaaaaatctctatgaggagggagtgagggagagaaaatgtctttccccagaaccctctaaaaagggcaaccattattaaataatcatttcaagagtattcatgtgcttgtcttcttttgcagcaacttcaacccttttgcaaatacccaagatatcctaagcagtgagttaacatgaggttgtttatgtctaatttgatcaattgttaatcaaacaaagatatttctaaaccttctattttctacccaaaatctaaaaattaacccaaaatttaggagcttgatcaattttgattcctaatgtaccttataaatgacaggtttacatgttatcattgaaatcagtactgccagatgtgttcctgcatcagtatgccctgtatcctgctacaacttaagtgcccatgctgttaatttacttttgctgatagcatttgtagctcaaaggatatcaacaaatcctcttaagctgttcttttgcttctccagtgatcaggttaccaatatcagagtgctattttctgattataccataaacattgtatctatatagtttgtttagttccatttgaggtatattgctgatagttgtgcctatgctagcttccaaatacagttaatataaccagcattttttttctatcattttgttcaccttatcaaactggtatctcagcgtttgtgtcactgtttcacccaattaatttaaaccctaagagatctgaaaatctagcacctgtgacagcacacattttctgtcagattaagttcatttgctcataggtgacgagccaaataagttccatcctggtagttcactaaacaagttggtcattgtatttgttttttttccattgggtctctaactgtttttgagctatctattgctgatcattaacatcagtatccttctgtaatgaattttatttttatgcaggtctatccaggaccatccaaattgttgcttaatggacccacttgacaatatataccctttacttgatcgccataagatccaacaaattcttcttggattgcaggatctcaatgtcaatgatcggtgtagactccgggcaccacattttttaaaggtctttttctcagagtggtacctgtttgctgcctgaattgatctgtgcaattgaaatgagacaaaataaaagaagtactaattagcgttccattgctttttagttgcatgcttttggtaattgtcacaaatcacatcttctggttgactagccttcttctccccattcacttatttatgcttacatgccagttatcatatataaattaaacaatctgttactgtcttaagacttcatgcttcaacgatcctcaacatggctaaataaacaatagaagcaacacaaaattgtaagcagtagcaactgggccatacaattgatgactaatgcagtttgcatacttgttcttgagcgtgtaggcatgatacagatatctcagaaatgcagtgcattcattttgttgcagctcccctgcaaaattgggattatttggagaatgttatgcagcctgatgtcactcactatccaaggtggcaagggaggaatgagaaatttaccctgctaaaaaggccaaatccttatgaatagcataaaactcttatgccacatcggatgggttattgagttgatatcttatcggtctgcatggccatactccttggatatggactgtgtcataatctggtttttgctgatttttatcactgaaggcgccttatttcttttcctctctttgagcattttcatgaagccatgcactgctaacacagcttctaggtgttccagaacgtgccttagtggttttatgggcctaagtggttgctcaaggcacaaaacctgcattccaggtcacgtttgaatatttttggaatgaatcatactaatgaatgctttctttgatggaatttgtagcaataaacatcatccttttaatgggacagcctcccaggttaatctctagaacataattaacaaatatgataattttgttatggtgctagtcttttgcaaatctattatacaaggtttaaaccactggtatcgggtccatactggtcttgagctggaacagtatggtactggtacagttggcacagattgaaacagtcattatcaactagattaagaaggtattggtactttctggtacatacctactgttctatggactaacaccaatgctgaccctatactgaaccacctgtatttgaatccttgctattatgtttgtgggtaaattataattgcatattgtgcttaattatgtaggttgatatctttcatgatcctagtctaagggatcgactattagaagctaatttatcctttccaatcattgtcaaaccacaaatcgcatgcggggttgcggatgctcataatatggtattctcttatcgtcttattccagtattccccttttcttgcccttatgaataatgtagtactgttgtaagcagaatgtagaagcatttgtggtgataacttctttcagcaattgtcatttgtaatgagaagtggctcaatctgcaaatggttttagttctgcaaacttggtcaatctttttatcttccagttggctcgactgacaactgacaaagtgcaacttcggctataaaagctatttagttgatttagttattacctatgagttccaagataacttttttatcttggactacaagaaagaaaattacagcaaaaaaaaatttatctccacctttcagcttttgagaaatggatatactcaaatcattgctgttattatctttaaatcatcattgttattatatctttatcattcttacttgacaggcaatatgacctagcattatttatgcaccatacaatttagttaagttggcttcttgctcaaatcattttttgttttcttatccttcctcacaggcattagtattcaagtttgaagattttgtggaccttcctgttccacttccagctattcttcaggtaaacaagaatcacctgcagatgatgcatcataagtttatatagtacaggaaaatttatacctctggcatcaaaatgaatatcaagagaaattgcgctttgtacattgtgattcagttttttacagtttggtcttttatagagttaatgtttcataagttattaccaagacttatgtggaacataaactttctgataatatgacatgctttaggtgttcagatgattacactgtcctaaaacaaaaatcttaaaagtgctatactaatattagctttttttggttttcatattggtctctctctctctctctctctctcttcttctctatacacacacacacacacacatatatacatatacataatatactatatatatacatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaaaccaaaaaataacttaaaagtagctatactaatattagtcttttttggtttttcgttatattggtctctctctctctctctctctctctctttctcgatacacacacacacacacacatatatacatatacataaatatacatatatatacatatatatacgtgtatatactggtatatacacgtgtatacacgtgtatgtacagcgcgcgtgcgcgtgcgtacgtatatgtacgtatatatagtcgagaagtatataaaatgtaaatcaggctacaaactagaactaattttgcttcaagttatgttttttcatggttcttttaaagaacttgagaataaattagatttgtaatcatggttggcttaatgcatccttctttgccaattgtccaaatcaaggcctattttcccacaaaaaggaaaaaaaaaagatggcatgtaatgttctcaaatgtttacgtttgttacagtatcgatcgctctccaaccactccacatgcttttgtgggatcaggtgttgagcaaactcttgtcaggtcatggatgtcaggtccattgaggtagagctatttagatccaacaattgcgagcacaagtcttggccaaaaacagtgactttaccaaggcccatttgacgatcaagtattatagagaagatgagggaataaggaagaaagagacctacagaatttttagatgcagtgattctatggtggctgcctggttgctcaagtcaaaatcagacgtcatgcatcaatacatagtttaggtaaagcagtcactgcagtgccctcaatatgagaagatccagtagttggagtgtgaaacataaggtccattatagtccagacaatcgcatcaaatatatatggactacaattagtaaggtggcaaccagataaaccacattgcgcagttatgttcccagcaatccaaggtcctgagaggggcaaactggggacagacctaccttttttctttaacataaagttgctgcctctggacttaaacccatgccattgcacttgtcagtgcaagcctttaccattgtaccaagcaatgggccctttgaaaaagaccattacccagttatgatctcggcaatctaggattctaggaggggctggctgagcatagaccaccctttggctttttttttccgcataaagtggctgccctaggaattgaacctacgccatcatgcttgtcagcccaagtcttttaccattgcatccagcaatagcctctttgcaaggtgacaattggaaaccttaccatcaaccatgcaaaataaatatagaaaaatgatatatgaatcataatcctaagccaaccctagcatcaccaatattatgaaatgggtcatgtaggccattaagtcacaatggatcagtcctacttcaattgctcttgtggtttgcattgctttaacatacagttgaaatttatcaaattgcttgtgtcataattagatcacttgtatgattggattacatgctgatggtgaatatgatatatcttagctgatcaactcccaataggactggaattggtcctgggctggcccgaggaccattgttccgggccaactttgagttgtgttatgggttaggcctgaaagattttggactggtttggagttaaatacagagcccatatgttctttgggttgggctcaggtatatcattggcttgacttgggcctagccagagcccgagcccgaatgaggcccaaaatggagcttgaactccagcatgaaatggagtccaaacttaggtacttgtttatgaattgcttagaagataggcatgccatttccaattgtgttatcaatttgcttttctggtaaatatgttctgatcatcggatggttgctaacatgaagctacagtattttatcagaaaaaatgtgaagttgcagtatagaagattgaaaaattaagcttcaatcgggtttgggccagccctatttttatcccaaatggataacttgagctgccccaatggggttcaggtcgggcctgggagaaggctcggttgggcatgggctgggattttccacaagtttttgggcctaagcctggctaggaggtaggaggtagaaaaaaattttaggctgggcttgggtagaagagtggcctggcccatcccggcccgttttcagccctaactcccgaaagaggagtagattttgttaaatgcagacttaaatcaattgagcttgaagagtgactatagcatgatacacaccaattatcagctgttggattacctgtatgattggagtacacatagcacatcagaagatcaatatagatgttagatgttctaagtgatttgtgatccatttcagttgtgatatcttaatgcatcgttggcatcaataggttatccagattgggctacatcatgcaagtttgattaaccaataaattagttctttgtgcttctaaatggtgagagcaacttttctggacagagaagattagagtccaagaagacctttgttgatggacgagcagaatacatgagaggtacaaattttgatggataataccctgatatctaaagttgctaggttgtgataattaaagaagatggattcaattcttaggctggaagttttggtcgtagtcattacttaacgaaaaatattgcttttttagaagaagaatagtctgaattgctgggaaaacatataacagcaaaggagggtagtcagataccttgaggagctgtcagttctcaggtttcattattaacacatcttttttgcctttaaatctgttgtggaaaaacagcccggtcacaaaacctgaaaaatgctttaaaatctaatcaaagaagtatttttcctgatttttccatcaaatacattttgcccaaaatcaagttacaaattagctgttcaataaaggtcagagttgtcagacatttgaacaacatccaaactcaattttatttatttatttatttttcaattcttgattgttttccacctttttatttagaaaaggaagaagataaaagatccggaaatccttgttgctctgcagcagttagtagagataagaagcaatatttcggaagatggcttcttggctccctgagttgtcagacattggaacgtccaaactcaattttatttatttatttctttatttacaattcttgattgttttcaacctttttatttagaaagtgaagaagacaaaagatctggaaatctttgttgctctgcagcattagtagagagaagaagcaatatttcggaaaatggctccttggctgcctggctgcctgccttatatcttttatcaatttgagcatagagaagtatatcgctttttgtattagtattatatgtttccaattttacttcccatcaactttctatatcttatttaatatttatgttcaattttttgtattataaatatttttcttggcatctccttgttcttacaattcttttaagttccttattttaggattccttgatcaccaatcacccccatagttcttacacataagcagctctttgcatgcccatccactacctaccatcttctaaaacatcggtataaagccatatgtttctaaatgcccaatgaaagaagctaaacagagattggaaggatgaacttgacaaaatgcaagagggtgggctcttgtacaatagtgaggttgctccattgcgatttgggcatcatgggttcaaacatgaaaacagcctttcagcatacgggggcaagactgcttacatttaaccttctccaaaccctgcagtagtgggagcatcatgcactaggatgcccttttaatttaataaaatgcaacaaattgctagggataagcttttggcgtagccatggccaatttgaagtttgaaacctgagtggattattctagatatgcatgtttggattactcctgtatcggtgagttgtatgagaaaattgacactatttggggtctgttgaagaagagttttagattggggttccaatatactaaacctattataaccatactctagtgtataatgagatgcatatctttgttactatatggtggataaaatgaaaatgcctttgcattgccttgctttcatccatacacttgaatttaactcatggaaatggttagctagtccaaatcaatagacatggtaaaaaggttggaactcctttttagttgaggtggatcataaaagttatctggaggcacttgacaagattattggagatgaaagttataattttgataatagtagaattacttttattaattcgcagttattaatagagatcctaaatgcaattacttggtggaatttatatgaaatgtagaatattaggttaatgttttggtagtaagagtcttcatgaaattaaactctttggtgtggagaggagttgaaacctgcaactatcatgcatcctaatcgctattcacagttgctgtgtagaacaggcaaaaaactgaaacctatataatatcttgagaattctgtgcctgtaaaaattcatctaataaagttcgccccatgattctaaatttccaattcatcctaacaaagtgtaaatggatgaagaaaagaaaagaaaagatgagaaaccaaccatccctccataattggtttctggtttccaattccaggtcttccacaagcctcccatcttttatcccatcttgtcaaggacaaaaaaaaaaaaagatccacctattctctccaagtaaattgggcctctaaaccatctctccaagacctgcaagtctctctcttcttcctaatcccattaattgtgtctcatctttcatgtgactactctcaatgttgtcgaaggcgcacctaaggtgctgataatgcaaaggcaccaccttcacaccttgtctgccccatggctaggcgacttcacttgggcattcaaaaagcatgccttttatatgccttgcaggaaaacgcatagaaaagtacattgtactgtttttgattaggaatttggtgattaaccagaagagagaagggggaaagatattgtagaaaaaaggagagaggtagacaggagattaagaggtggacgccatatagatctagggtttggagtctttggacaaatgcactaggtgttctttttcttccatttgataaattccttattcttcctgttcttcttctctttttacctcttactctcttttcctttttttcttttgggagatggactggccctcctctgctgctgcaactattgactgatgcttctgtgctcatatgtatgtgcgtatgcatgtgtacatatatgtatatgtacatatgtatctacaattctacatatacatatatgtatgtaacagacacacatatgtacttattatgtgcatgcatatccagatcaatttgttgttcctatttcttttccacagcagctcagaagttcagcaatgatttagcatcaaaaactctgctttttagtctccaccataaaatgtggaattgggatgccccattattttttactttgagcctcttacgtgcaattgggagtgtgtatagtgaatctacaaaagagttacccacttatattttaacattttgttggactaaaatgctacattcttaaggtaatacataacataggttatacacttgtatgtaaatactggtgaataaattctatatatttccatgcaatgtacaattttgaggaatgccatcataaggaaaagtgaaatataggttttgttatctggcatcatatggaaaaatgaaatataggttttgttgtctggcatcatatcttttctcttgcttgtcacattgccgctgcgctcaggcttcaagagaccttggcacgttcatgttccttggacctgtgaccactttgactactctctctccccccctcctctctccctctctctacacacacaccttggtggagagtatccattccatcaagtatctatcatccgacccaagtaattgagaaataagattaccatgattgtgaggatttgaattataaaaatttaaggccagtaattcctttagatttcatcctccaatcctcttcccctttttttgaacttctatacaaaaatatatttcttatgtacaaatatgtacaggtatatactacatttcagaaacaagatatagagtgacatggtttaactgtttgctattgatttttaatgaaaatatatatgagaagtttttcttcgtaattaattatcattatatgtgattatttggtaatataaaatattcttttaaatcattgaactcaaacttatatggaaacccagccttgttatgaaagcgacagcactattatcaaaataacagaaaatttcaattaaaaatataagatgtaattttaaaattgctattatgaatattatatattctatttggtgtttcttcacgttttcactcaaggggccaaagaaagcatagacttctattggagcaccaaggcgaaaatcctggctctacccttgcaatgcgtaccaagtccagcactccagtttgggaagttcaaaactagacctaaatggatgggcttatattttccagaccatcttggtacacttacccaggtctgcaaaatgcttattctttggaacttaaattgcaactagccaactatactcatggcagcttgatgaatacacttgacctgataggcctggcttggccatgcacatcagaagtcttgtacgagtgcctgctgatctcccatacaaaattcaagctgtgtatttgaccttaaaacttgtacaaggtttggaagcattgctttggtatttggactcgacgttccaacttatagttggctctacttgctgcactgctatttcatttgacttttagcattttagctttaaattgatcccttaaacaacatcatggagctgtagttcatggaatactaggtccaatgtgggttcttttgttgaaaacttcttgtactgataatgcaggaatatgtggatcatgggtcttcaatatttaagttttatgtgctgggagacaaagtatttcatgctgttaagaagtctatgccaaatgccagttttctattatcagcatcagagaaaaagggttctgcaccgattatttttaacaggtattttggaactttatgaccattctgctagcctctgcacattatgcctgtgtttaaaagcagatgaaagaaccaaaaactacaatggataaacagccgatatatgaacttccaatctagttttacaatggatgaacagctaatatataaatttctgttctaacttacacagtctgaagtctcttccagttgctactggggaccagttctcagcaggtgggccaaaggctgctaaactatctttagatgtggaactagtcaataaagctgcaaaacagctaagaagacaacttggtcttactatttttggatttgatgttgttgtaagttatccatgcctttctctactgaaatgtttaagctgtaatactgctgctgctaggtgcaatttaacaatacccaccatgatttacatgataagacgcttattagggttctctacattgctgattaggaggttttttagactattaatcgaagtacgaaagattcttttaagcaaaatatggacagcttaaatgatgctcccttattgttgtgcaaatttcaaatttcagattcaagaagtcagtggagaccatgtcatagtggacttgaactatcttcccacttttaaggaagtccctgattctgatgctgttcctgcattctgggatgcaatcaagagcacgtataatttgagaaaggcaaactgagtggtagccaattgcttttgattgtgctgaaatttagtctttttcatcatgggtacttggtaagtacaatattagaacttaacccattcaaatttatcgcgggtcatgagataaactgcatttcctagacataccattttggaataatttgcttgggtcataataaatagatgaacgtctgctccacaaaattcaccatgggctgttatatcatcatggtagcagatatttgagctttagttgcatgcatgatggagtagctgggattatggaaatgagtgatgttcagtaatgtcttgacaaagtttcctatcttgataacaatgtagttcaagtttcttctgaaatcttcatttggcatggttacgaaattcacagagaccctattttgatcactttcttttttgagaggactattctcatcacttttcacgttcagcctgcaccaaagaataaaccttttggaagacttcctgggtagtgagtattttcggaggctgtaggcataatagcttctttcttatctggtacacaaactatttagctggtgaaaccctcccaacccatcacagttaacgaacaagatataaatcatgaacagctacataaatcatgattctcagattcccatattccaagaaaaaccaaagccaaaacaaatttcagcttcagcatagaaatacaaaaacctttagaatttcctgaaatcaaacataccaagaagtggaaaaattgcggcattattcagagatatccaattaaaattgatgaaaaatatatgattatataaaactaaagatacagagcaagagatcctacttaagcaaaccgacacttgaacaaagaattcatctctttcagctaccaaacattcaagaaaagataagaacaagaatcaaacaccagtccgtaaatatcagactaaacaaaatatacatctaattgatgcacagagagagagagagagagggagagagaagaagaacagtgacttctggtccaagaaacagtgagaggccccttttgagagggagagaaccaggcagtcggtgtccggaaggtagtatataaaaggtgagtggatctgctgccatttgaattgcaagaaaccatggtgcagttggagttagagatcgcaggcccactggaaaatggagctcagaaaggtgtgtctcagtttctttatcagatccacaagcggatctgctgcaattcatgctgcattggatcctctccatgccaggggaccatcggattttaaatcttttttttatatttagtttggtttccactgcctttactcgtccatccattggttttggtttgttgggggaaacgccttatggcatgttacagtaggggaaatttgttgggggaaatgccaaattgcataccaaagaataaactttttggaagacctctggtgaatgttcaatccctgttgtactcctatcagcatctagcatgtaacttcagatgatctggccgatagagcaccttcgttgtggttcttaatctattgtcaaatgaccggaaacttcatctgtagtgcatcaagaaatgtatcccatcaatggatggaagctagttggtttttgatagtgatttgatcttgatgttttggtccaggaagttgaaggtttttcataaagaaagccgccagtctgcttactgtttctaaaataaacctgttggtagagacatctagtctatcctcaaaccaaattgctttctgtcctaaggacctctgttatttcacttcctccaggattatacatcaaaacttttattctgtttttacagaaagtaagaatatacattgtttaagtagtcattttcatcataccctctcttgagcagggccccttgctgaattataaaaaacaaagatcgccacttaaattaaccagcagttttacctttcaagcttctggtgtcactgagttgtgtaagaaacttgataagaatgaatatgatgaacactgtcaagcagcaaaagtcccatgtatattaggaaagtttcagccgtagatcttgttcttcagtacatcatattgctatcagctatctgttgctgtatatgacattgtacaagaatgacatctctatctacaaaagtttacatttgcaatttttcttgcctgtttgagaggttgaagttgaaaaagaaatcaccagcattagccagaaccagtcataccatcctaagagggaatccacatcaggtgtcacaataacatgcttcttgatattgcttagattgcagctatgctcttaacgttgatagctgatgcaacatgttgggtaaatttgatttctgcacatggagaaacctgcaaagcaaataatcaacagtagaaaaaaaattattgggattattgaagatgacaagcagaggagcaaacataacaatccgagcttcagaatcaagatgtgttcttcgtgaaattacaagcttgaaaccaggagttcctcatgcagtactagcatataaacacagcttgcatgagggttcaccagtaactactatttccaaaagatatatttctatagttaatattggtactctatcctaagctgcagcctcacagcagagaattctggaggcgtgaaggaactcagctttgctgttgttaaatcttaacaaaatttcctgtccaatcacaaacatcacctatgcagcgctgggaggatggatgctttggaatgcaatagttcccagatgctattactgacaaatctatgctgaagaataaacaggtgaagttgaaataacgtacttgccttaaagatatgaattcctactttacaatgccactcttatgcaccagcatcgtcctgaatgttcccatcagacttctttgaagatttatcctcaatctgtttcaatatgttgctagttgcatcccttgcccagtatttcccttcagccttgatttctttccccttaacagcatgagcagcagcagcattaggccgctttgcaactggaagagatgagggcatctgaaaaaggagcaggtaattatcctcactttcatcctgaggaccaacaaagcgttagggcattacatatacccacaaagtgatatttttatagtcaaaatagtataccatcaggccaggctcattttctggcttaatcttagttcggtcttgatctgaatttttgttttggtctggatgtggagataaacttggccaattcttcctcggctcttccaaggagaaatctgaaagcagcgttaagttcaggtctcttcactctttcagggtgcatacgttttgagaactcaccgtcatctgtgtcgcctgaatccagagggatgccctcattctgctgctggaagtgttaaacacaaacaaaaagcggaatcacatccatttcttcgcacctagctacctacacactgagcggcaaaaaagcaacaacatagaagggcagatattaggagggttagaggtccaatcactcgccgatggctcagcacattccttctttgatgacaaggctaacagattcccaccatctgcaggagagacatcacggcattctaggatggtcggcaaggacagaccggtagaacgttcaaatcagcaaaatatagtacatgatatctatttcaattaactaatctgagaacatttcctgtatcttgcggcattcaagtcttgctaaagctttagtttttgggaaaaataccaacaacaagtagcaaaatcatcataattggacggtagttaagaattgaaacgtgacccttctttgaatataaataacatattcaggtagtcactgcaaagcagtttttctctatcctgaatgtggctgtatcttagttacatcatgaagaggcaataactacacgaggatgaaatttaggtgaccaaacatgcatcattgccaattgaactactataagtgcttagaagacagttcccaaagctaaactatgatctacctggatcactgttatctgacgaagagtgactagataatgagttcattttctgcagcagcaagtgtagacattgaaaaaaaaaaaaagaaagaaaaggcagtccaatacatgaggcttccatcattatggagtctggagaggatcggatgtatgcaatattatcctcacgtggagagattgtttccacattttgaacccataaccctctagatcacagtgaagcaaccttacagttgtgccatggctcatgctctagcagcaagtgcaaatgtaaacatagtaaatgcttgttcttatgttgcatgcgaaaatcataataagatcagaagaaccctgtcactcacccatggctgatcatatttttttctttgatggggtgaccatatcaagagcatctgcaggaaataaaaaatattccattgttggatgatggtaaactaggtgcttggttaaagcagcaaatgagatggttgttgtacaagtgaccttgatgtttgcttcaaaaatattgccagcagaaatgccaaagggctttgcagacgttgattccctttcatcaatgtgcactgaggtacacatataggaccccataccaagatttaaagcatggatttatgtactggctttttacacagattcagacatatagcatacagaatccaatgtatagatggggtctgaagccggccatacagatatgtaggtactgacatgtcttaagacatgtaacttgagttcatgaaattcagcttgtgaagtatttaattaaaattcttgctatactacagttgctaatttgccattcatctatctttggtgcagaacaggatatgaaacaagggagagaatttgttaaccaaaagataaaccaaacccacatcccacccctaccattctcattcagcctttccaaaaatcaaaaatattttcaaagtttatcagatcatatcaaaagatttgtgcagcctccttggacttattccagatttctcatgcttaccaggaggccaaccaaccgactgatagcttggctgggagacccgacgatgggtccttcttgttcccctgttctctcccctgcaccaccagtctgctggttatggctgatttggcgggtgtttcttcttttcgttcttagtttctttttcttcatggggttgtaccccatcttatatgagtgcatccaacaccaatctctccaaagaccagcttgtgaaagagagtgaacgcaagtctttggcttgataagacatagccggcgttcgaaaatcaagctcttgcttatctttgaatgagactttgtcctttctttgaacgtcttgtatatccactaatcataattttgaagtgctaatctagacctatctagctgctcatataaaaaaaaaaaaatccaggaatagattgtcccactttcaaaaaatcatcattgcagtgcaaaaatggtgttgtttagtaaggaaccaaaatttcagatggtcaatgtgaacagtgctgataagattctctgcatattggtgttcataggcaagctggtttataaaatgttgaactgatgagaacaatacgacaagcccagcaatgacttaaaagatctagctggattctataaatacgaagttcttgggcaacacatgggagcatcaatcgcaactggcagtttacttgcttaagaagacaaaaatatatctattgatcataatacacatgtatttttgatgcatcaaatcactttcaatgaaaaaaattggagatattcacatagtcaatgcctttatatgtgttgatgtacaaggttcgcaactccattaaagaattggaacatttcttaagcaataaatcaaacatagccagggaaatgaccttctactaataatattttacagttggcatttgggatgatgacctttaaaaataaggcctttgctaactatataaggttggccttaggaacccatccgatatccaaaaacatgcatcttcttcaatatgagcatcttcaattacctttctatgtttcctgtctgcatttatgtaccctataggcctctgttgcacataatcgcaagtatatacaatctagattcattttgattgcttcttcccctatttgtgtgaccatgaagctaccattgcattggaatccacccaggatgtacaagcccttgatttagtccagttcttaggatgcagttgcagaaatctccaatttatccatctgtatcttcatttttattttatgtacaacaaggacaacatggtaagagcttgtgcctttcagcatcttattggctattgagtttaactaaaacctcaactatgtatatactggtactagtagcatttgatatgcttatttttgccataaatttataatcattagcctctaaatttgatatgcttatttttagccataaatttataatcattagcctctaaagaaccactccaccatcacagattttacatgctcctgtgacattgggtgcaaaaattgcttccatgtcacataaaaagagtgccatactaactgcattttatggcattttatggcataccgtagaatataattaagcaccaaagtgatgacatcatagcatcatatttaactacacatactgagacatgattggaacactttagaacaaaattttcaaatttaaattctgattaggttatttaattatcccagaaggaggttaccactatctaaacaacatgaattattgatgacactcaattacaagttgatgatagcacatcttaaaagtaaggctatttaagtttgcattaaaatacatgggtgatatatccctgatctgacttgcttctttgccagattgtcgtcctaagcacctgagtcatgctcctggtaaactggatatttttatagctagcaccaatcatttgtagtcttacaacaattcacacccactaagagcctcagtcttgtggggaggcacctaatttatccaaattgaaaaaccatcatgactggcctgtcaagaggctaatgctttgggagcttgttatcatgaaaggtatgcaagagctgcaagtagtctacaaaactacgacattcttgaatggtcccatgaagtgcttcaaaacttgtttacttctggctagttctagagtatggtattgatgatggaaggataaccattctatcttgaagatgactgtagcctgatatcttaggatcaaagttacacatccaaatctgtaaaaccctcccttttctgcatgttgcttccaacataatcaaagttgttatgactggttaagaattttcatttcaagcatagtagcttcagcaagaggaataatattttaggctttctactgggttctaacagcattgctttagcagtatcctaagatgtgtaaatgaataattttttctagtgatgattattttgtatttacttacctacacagcatattataagctaatttgagatgaacagcatcgtccagacagcaatttcctagttcctggacactgaggattccttctctccttacagcaagtatacacacttgatcaatcatgcccttttggataataggcattagtgttgctccacaaaagctccatttgatgctaatttcaattgagaataaacattcaatatgcattgtcattattggatggctctgtctggtcgccatctcatgaccaaacagtgtgcaaacaatttgcatggttaatttattaatgttcctcattttattcatgaacttctaccaccatgtcttcaatatctccaaacaacaatcacttgatccctcatgttccatcttctttaagctcatccaacatgaataaaaattagatccacgattaatctgattttatactccactatgagcttctgtgtctttcttgctgactcccttatcttgtggagaaaagaagaaaaactatatcatatctcatgctagtcaaggttgaatatttgcacaatctaacattattatgaaggttgattggaatatctgaatgtttttcttcaaacttagaagttgcctttcactacttctaatccttatatcatgacaaccatagtgttaaatggaaaagaactaagcctcataattggcagcatttacaatggagcaagatatgtatggacttgttgcaggatgtcattcatttttatgctcatacctttccgcttgcattattatgaagatttggctaattaggaagacccttggaacctcaagcatttctatcatctacctgaaaaactattagttttctacattctggtccactgtgagataaaggaggcaaaccagaaagaatataaagaggcacttcatcattttatattgattatgatatatgtaatacacataattgaaacaatgcatttacaagctatagaactaaggtctactatagatccccaaattgtacaaaacctacctttagttgtttttacattatgataacctagcaaacatataaacctcaatatcctcccactactacatgctttttatgcttataggcccttgttctttggctaacattttgatccataagtaacccaaccttttagctctttaatactattttggctcaagtctcaattagattatgcatgacttgcattactctggggattcacatacagcatcaaaaaaaggtacaaggacaggaaaagaaataaatccgtatcattatccaattatatagatatgcatttaaaaaatttagctagatactccacataattggcccaattttgttaacatcagtagattgatggataaaatcctaacctaaatttcaatgatcggtgtttctgcattttcaccaagctagaacatattgtccgcgcaacaggaaagaaaatgcaaaaactttttgagaatctaaaattgagtagccaatggatgcagactgatactagtttttagtttggttttatagcatagccttggtacaaaatcatgatgagaattgatcgtcttatcaaatacttcgaacagatagactgcaaatgtcatgcattattcgcctccgagctttttggtgcaacacgtaggggcacctattagcagaaatcaaagaacgtcaagaagtaggagtgaccattttcagaggctgtaggcatagcttctttctcatcttgtacgcaaactatttatccgctgaaaccctcccaacccatcacagttaacgaacaagatataaatcatgaacagcaatataaatcaaaatcaagatgctcagattcccatattcccagaaaatccaaagccaaaacaaagttcggcttcagcaccgaaatgcaagaacctttagagtttcccgaaatcagacatgccaagaagtggaaaaatcgcaccattattcaaagatatccaattaaaatcgatgaaaaatatgtgattatctaaaactaaagatccagagcaagagatcctaccgaagtaaacgaacactcacttgaacaaagatttcagccccttcctgctatcagacattcaagaaaagatcagaataagaatcaaacaccagccgtcaacatcaagattaaacaaaatatatgtctaatcgacgcagagagagagagaataccaagaagaagaagaggagcagtaacctctggtccaagaaacggtgagagctcttttgagagggagagagagagtaccaagaagaaggagacgaggaagaagaagaagaagaacagtgacttcgcgtccaagaaacggtgagaggtctttcgagaaggagggaaccgcgcactcggagtccggggaggtagcatgtaaaagaggtagagtggatccgctgcaatttgaattgcaaaagaccatggtgcagctgcagttggaaatcgctgccccgctggaaaacagagctcggaaacgtgtgcgtcagtttgtttatctgatccgttatctcttgcaagtcatgttgcattggatcctctccaggccggggagccatcggattttaaatctgttttgtccactccctttacttgtccatccattggttagttcggggaaacgctcgcatcacaattggggaaattagttgggggaactgccaactggaatatcacgggaacccggctgcaatgagccaataaccatgagtctatgccacccaattgatgggaagaggattattatgcttaataagttgattttgagtgagaagaggagcttttttttttggtagaagagaagagcagtttaacgcaaataaaatttaactctggttaaatcagtaatggtagtaaaacattaattggatctaatcaacaaaaaaacgagcatcaattagattcttcctttagaaagagattttgctttcggcttgacctcctatttgcattgtataaaaaaattagaagctagaattgatcaatttacaaaagttacgagggggggctgcaaaatatgagatggagtcttcatcgttgattgtagatgatctaaagcacaaaagtttcacgatacatggatgatctatgaattgaagcaaaactctctaaccaaaatctaaggatgcatttggttgaggtatgttagattaaggaaaaatccaataacttttgaaaattatttattttaaaaaataatttgtgaggaaaaataaattttatcatatttggtttgtaaaaaaattattctacaagatagaatggaaaaaatattattatgtttgattagagataattttatgtaggcatacggccatattttcaataatatttttgaataaaaaattcaagtaatagcatttttttcttgatccatttgttagccattcatggtctacttacacgaatgtcatcaatattatctattttgaatattaaaatatatttatatgagttaataaatatttttgaattaattatatattaataaattttacgatggtttgatatataaaagaatatattaattattaataaatcatatgttagatttattgataattaataaatattcataattgatctactaataatcaatatttattaataaatatattaatatattgttataatcaatattaattatatattatgattaatattagttatatattaatataatataattgaggatattttcatcaagaaataatatttttagatcaaataatcaaatacaaaaaaaataaatatcacatttcttgtagtatttattttatcttctctctcaagaaaataattataggatctatcaattattctatcgcttcttttatccatttttcataccaaaaatgataatttgatagagaatttattttttttataccaaattacctcccaacaaatgagctttaaattggagagaatgttggcttaatatagtgtagcctcctccaactggctcaggcaaataagtcataatatagtcactcatgctaacaaaatttacacatccagccaccatgtcacgaggggatacaaccacgcccatgcaacacataatcctttttttttttaattccttttcaacgaggaggtaaccaccaaatctaaaagaaattttttgcgcggtgattggcttacgcacagaactaagtaaaaaaaaaaaattttccacactactatctggtttcatgcatgagccaatcatcacatgcggtgcatacgttctgcatcacatcatgcggtgtacaaagaatttctcccaaatccaaaagctaggacaagccccaattgtgtgtacatatggccatattttctcaaattttctcaaagttgtgatgaccaagtgctctctggtgcccaactatttgtgaaaaatgcataactataatgcagatgcacttctcttaaaatctatgagacaggttaaaaaatgccctcgactactagcaattagaaaacaattacggaacggtcgttgagtcataatttaaacatgaagtccctttttctcttaccagggcccatggtctctctccgattcataattcgttctgccacgggcgtaagtttctggggctgcttgatgccgcgaaaaccttcacaaccgacggccgcataggcgtcggtgtggcggtaactcaccggttcctcaccctccccggaataggaccaggaaaggcacctcaatagccgtcttcgcggccgtcggcatagaggccggaagtgaccgtggagaagaagatgggattctggagaaggggaggaaatcgaaggaggcttttgccagagagaggagaggaagggcggtggaggagagcctccagaggatgcgatcatggcttcaggagtggagaatatcggagtgagaatggagaagggatggttttaagcataggggcccaggaaacgcgtctgaggcctgttcggatgatcctccgggatttttagtattggaaacacagcttggcccagcccatgttaatctaacttttctaggcccatttcatagggagaaaaatagatcttctgagatgcgtttttctccctataggattcaggctgacccactttgaacctatttttgagaattctataaatctgggcctgacccaggctgtggtcctatgatcatgctggattatataggatcatccaaacaagctgctagccggtgtgtcgaactgctgctaatatctattcaagaggtcaagaagaacccaagtgattttggtcaaaagaaaatgcagcatgcgaagaattctgcaccaacaaatggtagtttaagtattaacttgagcccttgcagccctcctggatgaaaagttagaacctttacaggtcaattgaactctaaagcaacaaccttctaaaaaaggggagagagcatggacaaatgtagactatgttagaaagctcttgagctttagtttgtatcttcatcggtgccatgttgattttaactcattgataagtagtagcctcctcagatggcaattaaaaattcattttcaattgtgaaccaaactcatcatctctactttttgatctaatgaaataactagacaaactagttaaagaatcaattatttgctatttgatcttattctgaaacttttgccacacataaggctaaactctaggatgattgtttgatgaatgatagtgatccaaatacattatagtgaacatattatccaagatttatgtaaatactaattttgaaactcaaaattatattaagatactaatgaatttgatgctgttatattaatttgatatatgcatgtgcgtaaaaatatgcatatataagtagatgtgcaatgcttgtgattgggccataaaggagtacttgatgaatggatgtaattaatccacattagaatagagtgttttcaccaccatattatgttttagtttatgtgaatttagatatgcacttcgatagcttgttaattcggcagacatttgcataaaactaattatataaacttatattaattatacaaaatatataactataattatctttgttatatcttttcttgagagggtaagataatcttacttagtataaataattatcttatttagtacaaataataatctagcttggtccaaatatatgaggatagttactcgaagcttaaatttggacatccttttgttgggaggaagagctagaggagggggcaaattataaggttatgtactacctaccaaaagagtatgtatttttgtggagactccatagtagtcaatttcatgggccaaactcttccttcaaaagatattaatatgatgttgtgatgttgcatatgtgatgatatttctctcttctactaggcaattaatgcataaaaatataaaactaaaggatagtatatgtcgtggtatagaaagaaaggcatcattaatcctgattgtgagtcaaggagaactttagcttatatagaaaaggaccatcttttccatatgaagtactttttaaaagataaaattatgaagtccatagactagagtggacaatatttcacgtgctgcaccataaaccctcgactgcaacggtatataaaataggcaatcacttttttagacatacaaaacaaaaaaaaaattctttgtagatatttgaattgcattttcctaaatcataataaaaataatttaattagttattatatgaagttctattccaaggacagatagataagcatattttagtacaaaaatagtcagagatttgtttgattcttaaacacaaatagttgaagatttgtttgattctcaaacacaaataacaaattgtatgtctcctcagaatatcttataagactctaccaagcttcgagatcatgccagattatctttaaaaatagccccgtcctactcccaagtgcgaattttgctaaataaatatcatgacctatacaagaaggatgatggaatgtttatagtgacaggataacaccaggaagtgccacagctatcgtctattaattcttgatgctagctagtcttgcactggcatggcatgacatgatccgaccgtcctttcttctgccgtacgaaccatttcttgacgcatcataagaaaaagcttagggagtgcatgtatatacatatggagcaacatttagcatttatcacccatgatgcaagcatggagatccccatgatgggacggctcacatccacatctactcccgggcatttaactccaccaccccatccaatgcttccctccgttttgtctcccccgccccgtactactcggtccacgcctaacaccaaaaagtaaatggtaaatccccatcaaatcccctgccttttttttttattcgcacgtgaagtcgagaacaaacatcaaatcaatagatgaagcgtacagttacttcgatcgccgtaaacttttgtctcctcctcgaaccacgtcattcccatccttcaaaaaaactgccacgtggcaaaagtctacaaatttataatattataaatatataaatattatgactacataaatatatgtatatatgcagcacgaatcacgaggtaagggacgattggttggtgctgacattgacgtgtctctattttttttttgcccctcttcacggaagtcgatgcttgaagtcaacctgatgaccggacgctggcccaggagggcgtgtgggtcgccttacccaagggtcagcttaaggatgggtcacctcgaagggacgaatctgtttcctctctctcatatattataacactttttctctcactatttctttggctctgaggcctcagccttcttttccgtgtccccccgtcgtacgctctgcactcgcgagaagcacgcgatcctcgctatgactttttgtacaaccttttgattcgaggaaaattttaaaaaaaagattataaatacaggtactaatgtttttgtttaaattggaacgcactcattcgcaaagtaggggagagttccacggagagaaggctcgtttatggaaaatatctgattcggccgaccggcggttttcatagacgacaatacaccaccactaccctctctgccaggctggagaggggtgtgtttacctacccttgctgtctggtgaaattgatacatggaggagactttcataggagtggattttattttatttttactttttacatatatatatataatttataagaaaatctaatattatgtttattttcaaatataaaaataaattgaaatgtaaatcgaaatagaatgacaatggaatgtggtgaattggagccgcgatttccattcaattgtttggacgtggaaaaaaatgtatgaaaaagaaataacaattggattccaatatataatttaattaattatatatttagtttatattaatttttcaaatatatttaactttttattttatattttattaattatttattatttactatattacataccttatgttgcggtcaatcccctgtagcgcctgtcgctggtgaagagcacctgcaaaatgaagtccatactaatcgaaattgtatccgacagagatcctctgatgctcaaataagtagagagtggtgaatagcagataagagtatttgaaatgacaaagtgttagctcaaaattatcttatcaatactgttcgtttacctccattttatagataattcagatataaccatcgagcatgtgatcccactttttattaggctataatcatagagttaatgggcggtttatgcctattgatagtcgtgacacgtagtcgatgaccattcataacggttaaacatgtgagttccgcatattcggacattatgtgatcatgaggtgccattgatcatgttctagcattatgtactggcagttcagataaaccgagtatatatcggtaatagtagtaggtcgacagtcgtggagttccgaatgagcgtcgatcgataattttgatatatcaatgatcatcagtcggatattcactgagtcatcgtggttgtccgtcgatggttgagaatagccgactgtcggttggtcaactgattgttagtcggagtattgtgttcataaggacgatgtagaatcagagtcgaggatcggttaaattatcccaatagttgccctccactcctaagtccaaggtggtctgacgtgtatattatcacgtggtctgtcacgttggacgaaaggagttgtcacgtgctgtctcgagccccgactcgactgctggtattaatgattttttgcaatatgagagatcttcagctattttgctgtttcgatagctgtgaaatcatcattgggctgtcgttttgataagataattcgacgcccaagacatctggatgatttgattctgtctagtagatattggccacatgtccaaacatcattggctctgagctgttcatgcagataacggtaaggtggcatgatctgggaatgaatgcatcgaatcatccgaccaatggtcggtcttgatgttgccacgtgtcgatatctgaggagatccaggtttgatcgattttatccagaccgttgaggggtcctatatatatacatagttattttcatccaggctttactttgcatttgttaacatcctcttcaacagaaggttctgctggaaggtcgccccagtactaggagctccagggtattatttctcgcaccatcctttgacttcaagttgagttttcctgtcttcctctttaggtttttctcccctagaggtttttgttttctctttttagttctccatttttcatggctagtagaaaagcttcttcttctcgggatagttgatcggagaatccaaccaacgactctccttcggatccagaaatgaaagcttcttctttatccgaacacaatgttgactggctttgggagcagtaccgtatcccggagcagtatcagctttctgctcctaattcggatggtcggatgaatttttctcctctgggtctggtcgtaatttaatcgaggaccttcgggtcgatcttcgatttttgattctggagttcatccgaaatcttcttgattattatggtctctgtcctgctcagttggccctgaattctatccggctaatcatcagcttcatcctattgtgtcagcttataccgactgttcctcgtccttctctttttcgatctttcttagtccttcatcgtcatccgaaggtcaaagattgatgattcttcaacttgagaaaaggcctatcttttatcatcgatctttcatcgtctattcatggatggaagaatcaatttttttttatttcttctttttctccttgagatttttcttcatgctggagtgatccaaggactggccctaacgagaacagtcggatggaggccaatgatcgaaaagattttctccgactgaaggatatggcagttttaccgcagtgagagctgatgaccgaataagctctctacaatgccggacttagttcggtcacttctttaggtataatatagtcggttactttatctttcatgtctgtttctaaactttatatcaatctttttgttttgattgcagctatgcagccaagagatgagtatcgaccgctgatatccgctcgcacgtatgctaccaagaaaaaggcagcagctgaagctggaccctctcgatcgtcgaataagggtcggatttctactccatcagtattggcgagggaatccgacattccatcagagatggttcctgagccaatcttgatgttgtcagccctgacaatgcttcctgaggtaccatctgttgaagatgggacagcaggagaggacggggttgcagcagtatcaatgacggctccatcagtagaggttcggattagggcgggagttgcaaccgaatctgagcagtctacagctgcgccagccgttcctccagcagaacattctcgagcgcagtcgagctccaactttccaacattctcaagcgttgaactgtcgatcgaagatcgagggaaggcgccagtgactttagccgatgacgggtcatctgctagccttcaaactcttttcgacattcggatctctaagggtgagtcagccttggccaatccgacattggccaagcggcttatcgaagctgctcttctcctgactaatcgggagaatagaaagaaccagactatcgttgaaatattttcttcctttcattcgatgatattcggggtaaattttctgacatctcttttttttatttgatctgacttgatttatcttctgctttcagtgagtgcatgacatgcacgatctaaaaagcgattatcggaagattatcgattttcgtcggtcgtggatggataaggtggtggccgtcaccatcgaaaagaatactgccgtcgaacaactctaagcagtaactaaatgggagaaagaacttcaagagcaaatctcctgaatgacggtcaatctacagtcctctaaggccgaacttgaatcggcatgccagaacatctcatccctcgagtctcagatcaggagcaagaagcactccatccattggctccgacgagagagggatggatgcattgatgaacttgaagctgaacacgtaaggcatcgggccatcctgaaaaggctggcactggccaatgctgagttggcctccgcacgaactgaagtaaagtcggtgaagaacgctctaagtctagccgtcgagaacttcaagaattttaaaaaaatcaagaaagaaattctcgaagacggatatgcttcctactgcgtcgggtatgaggacgatcgagatgcaatcgaaaaattatatccggacctagacttgagcagcatcattcctcctggctcgggagatgaagctgctgaagaaggggctacaccgactgaagacgacgcaccgactgcaccagaagctgctccaatcgtcgatgttgcaccggagcaaggagatgaagacaacgactggtgacaggtgtagcatttttattttttttttgtaattgaaagaattttgtaatcgaattttagtctaatttttgtgacttccttttcaataagtgaaagaattttttcaagtataatttttttttctatgtacttgcaatatcgtagaatcgtagtttgactatcgaatatcgatcgataagttgaatgttcgatagtaattgtagaattattcgttagtcgaatatcaattgacatactttttaggtattaggataaacggtgatcagccgaatatccttcgaccgatcatagtcaagtcagtatatctaattatttgataaacgatagtaagccgaatatccttcgaccaatcgtagtcaactcggtatagtttcaatttgatctggatcgtattgccatagtatttcacttagttaaaactaagtcggcataaatagttgttcaattagagtcgacttttacagtagaaaattgagatatagtcggtactgagatacagtcggtatattgatttttataataaaaattgagatatagtcgatgtattgatttttacagtgaaaaattaaaatatagtcgataagaattgaccatccatttatcagtctaatattactttgtagttggccaaaatttttgtgattatgaaattcaatgtttcattctgaatactgtacatatgaacaactttattaataatataactttaaatcgtcagcattccacatccgtggaataattgttccctcaagagtttccagccgatatgcatccgatctaagtatctcggttattttgtaggatcctttccaattcggagataattttttctgatctagaggtcttaaaacttttatttttcttaggaccaaatctcctggatagaagatcttcgggtttaacttttgcattatagtaccgagctactctttaccgatatactgccatccgaccttgagcttgttgtcgaacttctggaagtaagtctagattgaccctccaacattctgaattgctcgactcactatattatttcatcattactgatggtaatccgatctcaaatgggatcatcacttttattctataagccagattgaatggcgatttttccattggtatgcgaggagttgttcgatatacccataagaccggatataattctttcatccagaggtctttagcttcattcagtctgattttgagtccatacaagattattcggtttgtcactttcacttcaccgttggattgtggatggccgattgatatgagtttgtgcgtaatgtaaaaatttgcatagaactctttgaagttctgattgtcgaattatcgatcattgtcggtgatgctggtatgtggtagatcgaatttgcatatgattgatttctgaatgaagtcttccatctttnnnnnnnnnnnnnnnnnnnnatatcgagtttgtgcgtaatgtaaaaatttgcatagaactctttgaagttctgattgtcgaattatcgatcattgtcggtgatgctggtatgtggtagatcgaatttgcatatgattgatttctgaatgaagtcttccatcttactttctgtgatttatatcagaggtccgacttctatccatttgttaaagtaatcaatgacaaccactataaattttctctgatcagacgtcggaggaaaagaatcaagtatatctattcttcattgtgcaaaggaccatggcccaacaattgacgtcagctgactagtcgattgatgctgtatatttacatatttttggcatggttcacatcgttggacaagttcaactgcatcttttttcatagtgggccaatagtatttttgtcgtaagactttataaaccagagatttgcccctcaagtgatttccacaaatttcttcatgaacatctctgagtgcatagtcaacgtctgttggtcccaaatactttactaaggaaagagagaatgatctcttgtaaagttagccattcatcaaaatatattgcgaggccatccatatgagtcatttagcttctaagggattcgtaggtagagttccatcagtcaagtactgaatgatcggatccatccagtttggttcatcattgatttatagcacttcttcgactttatcaatactcagctgttcaaggtattcgacaaatgtccgacccagcgagttgaatgaaattattgcaagtctgaaaagtgcatcggctcgagcattttttattcttaggatgtgaaagatttcaaaatattttagaatcaacgtaagatcttttaccttctaaagatacttcatcataataggatctcggacttcaaactcgtccttaacttgcccagcaatcaactgtgagtccgtgaaaatcttcaggctgtcaatgtcaagctctttgacaatctttaagccgactgagagtgcttcatattcgactttattattcgaagctttgaaattgaatcgaaggacatattcagttacaactccttcagaattgatgaggatgagaccagctctactgtcttgtgtattaaatgctccatcaatatgtagcacctatgctgacgttaagtcagactcgagagttgtaacttactttattttatcgttaactttatcctcaagattattatcaggtattgtacactcgacgacaaagtcagccaaaacttgtgccttcatcgatggacggaagcgatattgtatatcaaatttgttgagctttattatccactttatcatttgatctaaagtgtcagatcgatgtaaaattaccttcaacgattgatctgtcaagatgacaataggatgtgcttggaagtatggacgaagccgttgtgatgatatgattagagcgtagatcattttcttcgctcttgaatatcttacttcgacattatgaagcaccttgttagtgtaatagataggtcgttgaattcaattttcatcctcttatccgctcttttctgtttcttaagcagaaagtcaaaggttcgacctctttccgatgtgctaatctgttatgatcaatctcctatagcgtccgtcatcggtgaagagcacctgcaaaatgaagtccacactgaccaaaattgtatccagtggggaccctccgatgcttaagtcaatgaggagtgatgaacagcagataagaatatttgaaatggcagagtgttagctcagaattatcttaccaatgtcgttcgtttacctttctttaatagataattcagatataaccgtcaaatacatggtctcactttttattaaattataatcatggagttaatggatggtttatacctattgatggtcgtgacatgtagtcgataaccattcataacggttaaatatgtgggttccgcatattctggcattatatgatcatggggtgcaattgatcacgttctagcattctgtgctggcagtttcagataaaccgactatatgtcggtaataatagtaggtcggtagtcgtggagttccgaatgagcatcagtcgataactctgatatgctgatggtgatcaatcggatatttactgagtcgacgtggttgtccgtcgatggttgaaaataaccgactgtcagtcggtcaactgattgttagtcggagtattgtattcataaggccgatggagagtcggagttggagatcgattgaattatcccaacgtcttaaatttaaaattactatttcaaattttaagattaatttttttatatttttatatttataatttttaaatgtttagtcatatttatattttgtttattaatttatattaattttttatatttatttaatatatttttactttttatgttcaatattatctaataatttatatttatatctttatttttttctttaacttgcattatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttctccttgtttagctattctacatttggtttctctttacttggtatgtaatcgagatattcgtttctctttacttagtatgtaatcgagatattccttcttcttgtaattgctacaataggtagaccttgtaatctatatatactcctattggagaacaatgaaatgcaagaatcagaaattatcctcaataaagatattaccttctttatgcattatacaatgctcatttattagtttatgatacagagtaaaactttttaagtactggttgataaaatattacaaggtgtgctccttgatatctttatttactaaaataatacattaaattaaatgtttaataaattatttattttcatttgatatcataatcatagataattaattcacatcaaaacatgctatttcctaccatttgataccataaaattattggttggttcattatcaaaaatatcaccaattcctattttcatgagaataaccattccttctatgtataagtaaaattcccctttcatcaagtgaaagaatagtgatttaaaagaaaatatggttttgtcctttattgtcatatcaaatgcttgaacaaggccaaagttagaatctccattccattacaatacgcatttcagggaaccaaatgtggtgcagagagttagaacctaagattttttaaagatctaaccttggaccataactaaccagaagtttccaaattattttagatagaatctgggtccagtgcaagtaggtgttaatttttattagttccagtgctgatcctcacaaacactaaaaattgatctctttcattagcccttgactatgattaaagatacccattatcatcacgctttaatgatttgaccatgccaaacatttggaaaaacacatcctagttcgaacctagaatgacttcaaaatggagggggtgtaattatagagttacagcctagtttgcatcaagcgcatgtgttggatggtcatcattaacacaaatatcatattgtgatacttccactaggatggagaaaattgaatcattgcatttcacgccacacaatgtacatatattatctatcaagatggacattttataggttaaaattgtacataattaagttggtggcattattctcacactatttcaagctagctagaatcaaaattccaacattacttataccacttagtcaatcaaaacctcaacttatcatcatgttgaaagagtttagtttcactgtgagaaaaataattttcccattatgagttttgttgtggcaaatagtatttgcctctaaaaacaattttcatatataatcgagaaaataattgcccttattgtatgatatggtgaacaaaaaaaaaacttttaaaagtatctatttacaaagactaacttttttttgcctctatagtttttttaaatatataaatacaaatattaattattgctaaaattttaaccatggtggctataaatatttaaagacaatttcatgaattttagcagctttttttttgtgctttagcatacgttgttgtaatgtttgcatcaagaatgagggtgcctaattcttatgtgaacatgaaattttctatcaaaagtattgggacaatacaaccgacccctgactctaactctacatcggtcgaatgagcatacgacaccgacttacaattggttgactgatcgagaatcggttattactgaccaacaactgatgactcaataaatcgtcgaccgaagaccatcgacatatcagagttaccagccgatgcacatgcggatcttttaccgacttatcagtattaccgatatatagtcggtttatctgttcaacacatcctaaccattgtgaacgattatcaactacgtgtcacggtatttagtgaaaattaacgacccactaactccacaataatggtccgataatttagtgccataaaaagcgggaccacgtgctcgacgattatatcagaattatctataaaagggagtaaatgagtagcaccggataaggataatttctgggtcaagactctgctacttattttatctactgttcaccaactcctctctgattttggcatcggaggattttcgtcggacacaacttcgatctgtgaggacttgattttgcaggtgctcttcatcagcgacaggcgctaaggagttggacgcaacaaaaagtatgatggagatcacataggaagcttaggtgaaaaaatagtaattatttaatttaattttgttgggcatgaatgtgaagctttacacttcaagtggtaggacatgtactgcactcttgaaggctcatgtaaaaggaattaattacgagcttggccacttaattataattccatggtacagtactgcacggcgcgaagtccgtcgaagggtcgccatttgatgtgccatcctaattaaccccatgggtctaaaatatagagggatccacccgtagccgatgcctcctcatttgatgcctcttccatgtcctcctcttaaatccggtctggtgaaaaggtcgttattatggtcattactattttcttttatgtcggggtgggaatggaggtgttatgagttgtggctatcattgcattgaatgcagagggatctaataagatggtgagaggatcatacaatatgtgcatttaatgtcatacatgtatttaaacctaggttcatttaagtttcaattttaattgtccactgaagagtggggttggggaagagagagagggagagagagagagactctgaataataccattctgtctcagctagcccaagggccactcatttattgagatgatgaaagaatcatgtaaattgcacaacttgtacgtaagagttatagttgaatagatcagtccccaccccccaaacaaacacacacacatataaagactactgttgtaatgaaaataactaatattattagtcaaaaattggacttttaacatggttattgcagctctccaccaatggagaattttacaagtttaaatcaataaagatgttctcacaataatttgacccgagaaatttacaacacttagttaaaatgattgtggtagccctacctttgttctcaaaaagaacatataacttaaaataattgtgtttgttattatgcaactatttcaagaacaaaattttggttttgttgagaaagataaaatttgattttggaattatcatggaatcaaaatttataataatatttaactatatggatagttactatccatattatataataaataatataatttggcatgtgcaatgcatgcagaatctgtggatgattgtaatcctttaatttgattaaagttatttatgtggataattgcaactcaattttagaaggcccaaaatgaaaaatgaatgatgtgggctgtactatctcaggaatttttacatgcatacccctacaatgtggtttgtttatatgtaaccttcaaaaatctgtatttgcatatatagctcttgatttattctatttttgcagtgttgcctatcatgttacaatgttgattgttagcatcaatatgtatccattttaagtatatataagatgattctattatactttgttttagtatacattttttataaaaaaatccacttttaatttgtattgtggagagctatgttttgcataaactttttaggaaaaaaagcaaataggataatagagtcactttatatatacaaagtagctacttattgtcactaatagctgaagaatttacaagcatgctagccactgctgatggactaaaatgatgagtatatatgcaaaagtaatttttgccgaagcatttaccataagtcatattactagagacatatatgcagaaaaatccagtatttaaagtatggagaagtattaaagaagtgtgaaagctgatagtcacacgttatgaagcctcatgaacacttaaaatatgggataattagaggagacagattttttgaatattttgtgccgatacactcacatgtaaagttgtaaactagatgatctgatgcattcaaatgtacagtgaaatatctattttaccctccatataacatgaatacaaatgccagtgggctacataaagattaaagagcatattaaaacgtttgagtatcctgactgaattgacttagcttgaaatgaaattgttataacattcgttgctctaattattataacactctctattctaatttacaggtacctaattgctaaaacaaaagcaaaacaagaattggttcaaataactgccacaaacacttcttgaatgttggctacaatggagaacaatgattcaagaaaggagtaagagaacggcatgagttgcttattctcaatggtaagctggtgcttgtggaaagaacaaaaccaatgaatcatccactttgaagccattacatcaaaaactactagcagaaaaagctgtatctctattactagattggtcatctgtgccactgcaaggagaagcagctgaagatagataaagcttgtgctacaacacaaaaccatcagctcactggggaagtgctgtgcagaagcaaacatttgacttggtgtatgatgggactagacgcccaccagctccaaaccctctaattacaagcttcgaaccctcttaacttcttatgtaatgagatggtttgtaaacaggttgtccgcatacctggtaacaccatccccttgtacacaatctcctttgaataataaatctggagtaatcacctaatcatatactaaaaaaaaaaaaaagaaaaaaaagagtgaattgataagtctatataaaaatttgctaaaattatttcaagatatgctaaatattcttaatcttatattatttatctcaatgaagcatcttactaattctcaaaatctaatcctaacaaacctaattcattttttagataacctaatttggctcggattattcaaaccacaagccatggatgtagaacaagtgagttatggttcaaactgctctctacttagtttttttttaattaaaaaggaaaataaaatatatttgtgtataaatatataacttccattttagcatctcttctatggagaagctcaaattgaatggatagaatagatgaaccaactaccaaacttctttttcattgcttccattgtcaaacgttggacggtgtcaaggaagcagtcaagcaatcactaaacccaatcctatattactttaaaatttggctttgccgcctaaccccaagcccaatcgtataatacattggattaaattttgggacccaaagaatcccaatacctccctaggtttagttttcagacccaaaccctatagtttgggtttgcttgagattggtttagcaatttattgccccatcttgctgtgtccaaatttgataaatagactcctaattgtataaagtgcatttttttcttatttcttccttcaaaacaaaaatgaatcaaggagtatatatatttgactttttttaatatacctttgaaaataactatggcacatataaccctcgtcataaccttttttgttaaaattcatttttcttgttcaatagcattgcctctcatgttatgatttcagcttttggtgtcaattagtagttattttaagtgtcaaatgagtttattatccttttttgatccataatatacctagaaatttccaatctttaattcatattacatagagattgttttgaataagcttttttgggtactgatgcaataagataagagtcattttatatttaaaataaatgcttactagcattgcttggcaaaaatttaacaaatgagattgtgctgatagggtgaaaatgagaaatttatgcacaaataatgattttccctaagtttggaatcagccatattgctaaaataaatttgctaaggaacaacatcattttaaaatggacgtattatagcattgcaaaggtcgacaaccatgtgtaaattgagtcatctagatggttttctttgcttttcttttttttccatattgtgtgctaaaacactcacatggaaagtttaaaccaggtgctgtttaattgaccctgggatgctttgtttttttttttgaaggatgaaatttctattttgccctccatacctaccttcatgttgctttccaattatttgaagattttaacagcaaaagggtatcattttcattaattggataacatgtataacatgattgttcatgttgatgggctaaatgaaaagcatattcaaaaatttgactagtggtggctgaatgattcagtttgaaatggtataaaaataaccaaattagggcattaacattcctagagctatcgaaggactccaatactatcataacatttgttattttgagatgcaaatgcctaattgtgaaatgtggttcaaaataaactagcttggaacataggtgtattaatataaaaagacaagtaagctagtaatattgtatcaaaattcatttagattctttgtacatatatgtaatagtcttaatcattcctcttctttttctatcatttagaatatttctatactaataatctcaatcaaacaagttattttgtttgtaatattattataattcatgccaaattataatactaaaatttatatttaaaaataaaaaaatttataggaacatcttttctactttagtccaattttacttacactcttatattttaaaaagtgtcaaactagcctttttagttattgatatatttcaatatggtccagctattcattttattaataaacggtgttagatttctctcaatggacaaaaatatcctttattcatgaatggacttggaggaggaagaagatgggaagaaaaatgggatgaggaagaaggagagaaggaaaaaatggtcatgggtaaagaatggattagaggagaagaagaaggataagaagaagaagagggtggagaggaagaagaggaaaagaatgggttatcgatggaaaagggtggaggtggaaggggccgccatgaagggaagggcttatgggcggtttgaaggaaaaggaggatgaggaggtgaaatggataaggaagaaaaggaggtggagagagccatcatgaaaaaaaaatgagtgagaaagaaggagagaaaaaagattttttttgccagtaagaagagacggatgtagaatgagccatctaaagggatagggctcatggattggtttggaggagaaagggaatgagaagaaaggggaggaggggagaagggctacaggcaaagaatagggtggaggaggatgaaggggaggagaagaggatggggacgtagaagatggggaaggtaaaaatggatgaagctatggaagaggctgccataaagaggaatagtttgtggatggcttggagaaaaaagatgaggaagagaagtgtacaggaaggagaggagaaaagggaggaggagaatgggtagagaaagtggagaagaaaggaaaggaggagcatgggtgaagaaagggaaggagaagaaatgagggagacagaggaggaatgggagaaggggaaatgaatgagaagaagaagatgaggaaagaaggagaaagagagacaccagctatgaaagagatgatcagttgaagaggagggaggaggaaagagatgtgttttagaaaagtttattaatgaaaatagactgttggataatgttggaacatatcaataattagaaatgtcagtttgatacattttaaaatacagaaaatgtaagtgaaattgaattaaaattaagaagatatttttataatttttttataaaaataaattagtatcttctaatcttattggagctaattgatccgtaaagaaaaaaaaaaaaaggggtaacgttctgaggaccatggatgaagggattgaaagggtcagatcagttattgttaacggccgttacttcagattatgggtttagaatggggtgaagcgtcaaatcatcgagacctggtcaagcgagtatgcgaccacccaactcctccttccgggatcccaccccgcccacacccccacaatcccatttattcccttctctctacccatctccatttattatatcacacttactctctccctccctcctatttttcgccgccccatctccccctaccatctttcggtgcttcgcctccgcttatctctctccttgctccccctcttctctctccctctctcgacaactcccctcccttgcgctggctttggctttaatccaatcaaatcaagtccagccctcactcacgcggagataaaaaaagagggagacgaaaaggaggcgcagtgaagagcggagggcgggatccggccaaacaagaaggaataaaaaggtaccttctctctttttaacggcgccgtcgcggtcgcggtcgccgtcggatcggataaccgccctttccctcttttctctttctttcttttccaaccaccgactcgaagaaagcgatgagttagagcagagaatggtagatatttatttacatcactcattgttatgaaatttttttcattaataaattacttgcaagggatcaacgcgtgccagtcctggttgctcgctcttaacttcaataaaataaaataagctgcagaaagatctcccgaggatatcagaggaagaagagaagagaacaacgccgaactccttcgttattctcgacttatactttccaattataagatccgtaaccggtttttattttctttcattttttattttttacagttggatcgcgggatttgtcggcaaagcaaatccgacaacaaatcccacgatccaaatctttttctttttattcccctttcctgtaatccgaaatagagaggatatagaaagtacgcgaagggatatacgctcatgatcacgtatcttttcaccaaacctttcttgtctcttcattccatctttataccaatttcctttctctcttttgtcctgttaatatgtctccatgtatccataatctaatcaaaatatctcaaagctaagagaacaaaatctctactcacttcccgtctcaaaattttttctttttttgagaacttttcctcagaattattcaagggaagaggattcttactgcgatggcgtcgtcgtcagcgccggtcccggcctcatcggccgcggtgtcgtcatcgatgaccgcatcgacgagctcgccatgcgcggcgtgcaagttcctccgccggaagtgccagccggactgcgtcttcgcgccctacttcccgccggaccagccgcagaaattcgtgcacgtgcaccgggtcttcggcgcgagcaacgtcaccaagctgctcaacgagctgcacccctaccagcgggaggacgccgtcaactccctcgcctacgaggccgacatgcgcctccgggaccccgtctatggctgcgtcggcgtcatctccatcctccagcaccagctccgccagctccagatggacctctcctgcgccaagtccgagctctccaagtaccagtccgccgccgccgccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccgactcagctccagcaccagctccgccagctccagatggacctctcctgcgccaagtccgagctctccaagtaccagtccgccgccgccgccgccgccgccgccggcggcgggtcttctgcccccactttcggcggcgggctggccaccgccggcgtgcacggcttccttaatgccgatcatccgatcgggttcggaagggagcagttcttcccggcgggaaataaccgggagccacctcgtcccaaccagcacttgatgatgaggaattttgaaggggagttggtggggagattgggtgcgaatggagcatatgatgcagcaggaattgtggcagctatgaatgcgtcggcggcgagcatcgggccattgggtgggcagttcctgaagccaagttctgccggcaggaatgaccggccgagcgtcgggccgtcgtagatgtccttgcaggtttctatatattttgctactattattttctgggtgcttcctcctctttgataacactatgcttttatttgattttagtgtcaagggtggttcttctacattagtagtcaaaagtaagagcttgagattagctgcatgatatcgcaaaagtcatatatgtaaaagtagtcaaactattgatatatatatatatatatatatataatttcctaggtaagtaaggagttggtaggctcctaggcaatatttatagtgatgagatgatataaatatatgtaatgtttgtttcatagctaagaaaagaacggagccgaattttagcagttaattgttgcaaattttgtgacaaatcacttctctggctttaatattagttggtggtttcggttaagaaggtcaaatactttgggagtagtgtgggcatgcactgttctacgtaattatcaaaaacctggtataatacagtctggtagaaaaatcccttaaatctgcatcgagtaactcgtacaacattgagcgagttcatgcagattatttatccatttagtgctttaaatttgatatatctgccagttatccttgaatggttatgctttaaggcatgaaggtcattttggatgacatggttagccgattctagtgccccatagagatggagagttctgtggttcaaactccttaattttgaagaataatagcatgatgaaattttagtgtcccatggaagaataatagcatgatgaaattttagttaagactttgaagaatccttaatttgctgcagtaaaagaaaagaaaatctgaatcataaagctattgcttggagaagttcggagcaaattatgctgctgcctaactttgaataatggcattcacacgaccagatagcataactgtgtgttgaagcaaggagtttaaggtggattggccttcaacatagagaacgtttcagaatcaaaggctgaacaaatggccgcgggatagcttttgtaataataatttacatcaaaaaaaagtttttgttataataaaatatatattgcattttaagttaattggtgtctatttctagctgttttccaaatagatattatgctccaaagagaagctcgttattttgatgtatatttcttgatcacttcaatttgaataaacctccagaacttccacgatcttacttcttttcaccaaaaaagggagagaaatgtttcttttaaaatataatgaaaattctactgtaaaaaatcttctagcttcttgtttctttcagaatgaagacaaatttcttatggctttggcatgtggtgcatatgagtacatgccatgcctgcccgcatctattgtgctgttggcatcaaagtttttgattgcaaactccatcaggttacactgttcgatcacagtttcattaacagaaactagcgttagaaaaatccttcaagaaaagccgcttctatagttaacattgtttggattgggttcagaaaatctaaaacttaagtatattgttgagttgcaggtataaggcttggaggatattgggcacttgcggatgaaactgagagctagagagttagaattgacaaagacgcctggattttaatttcaatccatttacatgaaatagatttttcttttctcccccttgttttatcttagcgttgtttattttatcctctcttcttgatctggccagttggacattttgtattccgagtgcttgttatagtggcagtcctagttgctgtatccccccttcgttacctgcatggcttatttgatcttcctcacccttttctgttgtaatgatttttattacctgttaacagaattttggaagttattttcaaattgttcgagatgccaagaagaaagaagaattgttttttgtggggaaaaaaatccttccactttggcccaaattttactatttgctcataatgtcttaactgtagaagggacccacttggatccattgttttggaatcatatccaccaatttaatgcattgttatggtggattcgatttcttctttcctcttgcatcttataagaaattgcagatctgttgggatatttgggtgctacttccatgattaataaaccactcatggaatgtttatcacttaaaaagatttccatacaaacgtactttatgggcagggatgactgaaatctttgatagggtccaagtgctgacaataaaattataaacatccatcatacgatacctttctttcggtagatatcagttttctcatcattatcaaaccttacataaggctctgtacccataaaattctgatggtcatcacaagatattgtcttgatgcctgtcaataagaagggtaggtctcatgacaaccatcatatggttaagtcaatatcatatggtcaaggtcaaggaatgtttatcacacaacaagatttccatacaaaataaattctatgggcaagggtgcatggttgggaaatctttaatagggtcaaagtgctgataatagaattatgaacatccatcatatgatacctttccttcggtagatatcagttttcccatcactatcaaaccttaaatagttctatgcccatgaaattctgatggccatcagaagatattgtattgctgcttgtcagcaagaaagataggcctcatgaccaccctcatatggttaggtcaactacattccatattggtggtcaatttccaaagacaaaggtacatggagtggatatattgacagattcaatggtgatgtagactcagaagcatttgagggaagcccaaaaggttagtatggtgagttaaagctgaaacatttatgggaagcccaagagggttttatacctattcctctgagtcttcaagtaagactgtaagaggttggtggttgaccagagtctacaagacttttcctttctctattgtctaaaccctccattgtgaatgagtctctctcgactttgcggagtgatagaaaaatgacagaaatagggagattagttagggatttgaggtggcagaaagcatttatcagagaagagcaaaagacaaatcaacaaagacaaaaggcctttctttgagagagagagagagggagccatcaatacaaggtgtcatgaaagccttcccaaaatgccgttctgatgcaaacttaatgccctaaagcatttataccgtcaccaatccccaccacctattaaaaaaatccaaaaaaaaatgccgacttgagagagagaacccttcttgctccctgcctctctagagttgtgcagacattcaaaacatagtcaaaacatacatgccatgacattgctgatgtacctaagcaatgatgaacgcatccttaaatgcatgccctttgctcacgtctcctgcgccagcacaccgtaccagacgcagatggatcccactaaaaaccacacgggcgacatacatgaaaatattttgcaaaaaacaaaaatgaagcattacaactctatggctgtgcttagattggtccactgccgatgggtctgatccaaccaataatctctctctctatatatatatactcatccatccatccatctttatatccatgcatagtacctgctatcctcatgctcttgttccgaactcttcacttggaactcatgaatcaaataggctgagcttaaaccacatatagtaaagatgttagagatttttttatgcgcccattgctcacaatgataattcatttttcttctacacgtaatgctatgttcacagcatttttttacaagactttggttatgcatatgttgactgcagtatgtttagcaacaatacaaaaaaggaataagttttactctccttgggaattgaggaagtcaaattgaatagctaatgttccgtacttgcattaaagaattatgctagagcggcaatccacaaaggcatcacccttttgactcatactatgtgctctcgatctgtacaacaaaaaaagcgcatctcgtatagttttgctagtcttgccagtgatgctctccatcaaaagtcacgagctaaagttggagtgccatagtgccaagactttgttcatttcaatgcttatgctactgctgagacgtgactcagataacttggctcggtgagtaggcaattatgaagtaatgttggattcattaatcttgttctgaattttctcccttgctaatttatcttccaaaattttcatggcttctcacgtttcctccatgtttagctgtaagtttatgaataattcatttatcaacgaaaagtgcggcggatcatccgctgttttgaacaaaacaaagaaacctttcagtatcataaattttaatttatggatttatagtggaactaagattcatgcaacatgttatacattagtagctttggccggattacccaagaaagccccattgcgataggagatcatgatatcaaatattttccccctttcataacttaataagaaataatactagaattttaaattttaaccttctttttgaaaaatatgagagttatggatccaaacaaaaaccaagctgaccaactgtagctttttcatggtttcagtttacgtggcaccttcgtacgttgcatcattgagttggacatatacatatgtgcatccaaaaaaaagttggtgaactgtgtgctacatgaaaagagctgacttatgctaagaaaatttgagagcttcccacgttcatttagaggaaaatttcttgatagctattaggtggctttcagtttcactgtttggaggtgtcaaacttcagtccctcgtacagaattaccagcgaatggtgcacttccgactttcttttgggatgacacatgttggagtattattataattatatatatttagaaggatatatatacatatataatccattttgtatccgtctaatgcaacgtatctataggagcatgatgcatcaaacctagtttatcacacacacacaacaaaaaaaaaaaagtgctgaaccgaaacaacccttcggctccatccacatggagagaagagtagggtccgagtccaagccgtcccttcttcacccaggaggcatctaatcaggcacatcaacgtacggccctgattggagggccaccatgaacagccacgtgcatgggtagccccaacgcccattaatggaagaaacaaagagagagaagcacgggttcaaagtttcaaacgcacccgcacggttcccgcggcctgggctttgttttggagttggggagtatatatcaatatacgtgaggtgatgtttgaaaaggacggtttagagggtcgggggatattccgacacccccacgcgctcggttacatgtgtaggtggcaaaagagaggcgtttaaagccttgacacagaaggaagaaggaagagctgtccatcatgtaacaccaattttaacttttaaagagagagaataaagaaatggactctgatccctacaaagagaacaatttaagtgtctataggagggaacagagatatgtacatagatagctgtgatcaatacttttttaaatataagagagagtgagagagaggagagatggcggggtagttataaaggatgggagaggatgtatttaatggtggggatggtggcatttatgggacagcgccaagaccatgggccttatttgactgttccttctcggagtctggccagttgcacgcttttccagtaatagaggagtgagaggaggaggaagggaacgatgagcaaaataaagaagagaataccaccacaccccgtatcatgctccttaaaaacatgctttctgtctcctgcccattaaagacatttaaggctgagagaggaggagagaagcgaggcctctagctcatgcatgtggtgggcctccttatttataccagttcccacgcaaccttgaagtcaaggggctctaattgtaggaaatctctatgcgaccttggaaataaatgaataaagatacgggttgatgctaacaccttgaagagagggctgggagagggactaagcttggtttcagcctcaagataatgaccacatggaccaaaatccttatattgagtctgtgtgatgcgtgtgttttgatgtttgtacatgtatccattgatgtggagaggtggttgaaggagacttcaaatattgcaatgcactcttttggaaaatgtaattggatgaattaaggattgagagctgagaacaggaatttagcacttccaccaacctgaacattttccttaccctggcaaagctcgatggaattgtatttgtatcgggaagtgcaaccatgagcccttcaaaagtgcatcctgttcttcgaaagcaaatacatctctcaaatttgaacacgttggatctatctagagatttcaagtgagtcttggagaccaagatacttgtgtttcaagggaaaaataaaattgtggctagggcatgtggaattcaccaaccttgaggattggtggaaggactccaaggtaaaggttaattctccatctttgaggaatattattctaaatatagttctcaaagtagatggcatgtcaaaactcttaaagtggcgcaatttttttcctatacttatagcatttgagtaccaaataacttagctatgctctacctatatttttgctctattctccgatggattgtggtctggacgcaaacaatgcattggctcttgggaaaggattagactctggttattttaaaagccacatgcaattgttccgttgtgctgaatgcagaagagagccctcatagaagcatcttggtcccaaatattaagaacctgctgtaaatggatttatatgcactctacttagaaactttatatagtagccgatagtatgtagaaaggctcgatcacccacggaataagatcaattggcctaagctcaccatgaacaagcaccaataacaattgagagaaggatttgtgagaaaaataaaattttaaaaaaaagacaaatttggagagacaataaataatttttattaataatcaaattttcaaaagttgaaccaacattcttgcttctactataagaacattttacaaaattttatatcaaaaagtgcacacctgaagaatcaaattatcttattgcaaagtccatgctaacgactttatggaagtaactcctcaccgagcagtagctcctcattagggatggcaaaatcgatccgaccagatggatatgcaccatatccagatccgatcaaatccaaaaaataagatttgatcggatttgggtaaaacccaaaaactgtagtacgggtataggtaggatatgagtagtgctattttctatccaaattcgaatccgaacctgatccgaacctacggatatgggtaatatccgaatccatatccaaatatatatgtttataattttattttggtaattctattttgattgataatatgcataaaattattttggttgtttatatattctatgttgaattataattctatttctatatttgatttctataaatttgaacttataaattatgttctatgttgaatttgtaattctattttgattgataatatgcataaaattattttggttgtttatttttttggttatgagataggtatgggttgggtatggagaaatgggttatccgtgggtatcctctaactcattgagtatggagatgggtatctcttttcttatccgatcagatataaggtagaatttgggtatagagtattaagtttgggtttgaagatggatagtacaatatccgatccaaaccctatccgttgccatccttactcctcattgacccattgtgaggacctatatcgatatgtatttagtctcacatcaattatttgataggaagatctaggttacttatacagaactgaataatctaaataatatttttcggctagtctttttggataagatcctggattattattaatagaatcaaagggatccggctcataagtcatctggaatgggagatattatagcacggattcattgagctagcttaaatgataagagtacgtgaggatccatgcgggtaggggtggaaccaagccgggcgctacccctatccaagcctagttcaaaaataattttcaggcttcaagccgagctaactcctaataaatgtgtaaaaatccaggcccgagcacaggttcgaatccatttgggttagctcgagacattacttagttcaagcctagctcgagctcaacccaatattaatataatgtgagggtggtggttcaatgattcacattatcgatcatattgatttgaatataagttttcttcatgcttaaacctcttatcatcttttctgttattgaactttcctattttaattctatcttaccttatgctttaggctcggagtgtgccttgttcgagacccgtgggctccgatgaggagagaccgtcggaattctcggggccgttggacgaggcctcaggccactctttctgctacatgtgctctgccatacctgcccactcctgctcatccttcgctgccaccaccaccaagaccaccttcacgatcatctccggtgcctccatctctgccaactcctccatccccctctcaatctatgatgccccgttgttgtcgccgcctagtcataggctattggcttccgaagctctagatccttctcaaccatcctcctttagctttcagtggtgggggtttcgcatcggggctagttaatagagatttgttcctcttcgggccgattaagtagtgtgcgctctggagcctattcgatgccgtacctttctttagcatgctcatgaagaagaagagccgggatattttgaggaggctttgaaagctatccctcttctactagagcctctcggagaaaaaccgccaccttagatgttccccctctggagcttcactgtctgatggagcaaactcgacgacgtgccccctccagaagaaacaaagaagagaagaagaatgtgcgaacagcggtgctgcaattgaaaaattaaatgagaagattggaatcgaaagagttagaagagtgattttgagtttggagtctccgagcctaacttaagtcaaatggctaagcttagccaacttttatacatttagatattggggcctaagttttgtgttaggatcgcacttgcagtcgagcttaggttggggcaatggtaggcccgagcccaatccaaaaatgaaatgggctccatttctaaacccaaatccggtctaattttgttcggatctagcccaacctacagtcgagcctatccgagtacattttcagcctcacatgcgggtgtatatttagtctcacatcagttatttgctggaaagattttaaatatttatatagaatcgagaaattcaaataatatcttgtgactaatctttttggatggagttctacgttgttacacccatcctctccaatgaatgctgaaatcgatgacctccacactctattctatagccaatcaataataaattgtttggcatcattgttcttatgtttttttctttcaacaaattaatcaaataccatatggagattgatgttaagtatagcatttgcactattttcactctcttttggaagctcaaaaattttacaaacaatttcaagaaaaaagaaaggttccaccatacgtattgtttagtttagttcatttttcatcatgaattttaaaaattgataacaagaatgatatcaagagggcccttgtgcggttaaagcaagccactgagtctagattagcagctcctaaaaagttttatcgatcattcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactaaaaacttaaaaacttaaactaactaactactagagacaaacaactactactctctctctctctctctctctctctctctctgtgtttgaatgcaaatacatatacatacaacacacaaatagacacatgcatgcatagagaaaaaaaaataaaaacatataaaacccataaaacaatagccaaattcctactcagaaaccaccacctagatgtcacccagctgcttagaaaggcccccaaaagggtagtctcctgcacattctaaggcccaattcctgcctaagtgaccgcacacaacaatgttactaaagcactaacattcatgatttgccatatcaccctaaaccatctgatatgggatgtatcgagccaaacctacaaggaacaggatggttccccctgttggttcaatacagagcccgagccctccccggctcaattaaaaatccctcacccagctctattccctcaaccaactcagttaagcacccccttcccctcaaccaccgaccacttgcaaacaccatcccaatgctactagtgaatgctgcccctacaaccgcttatgacagccaagagtggtaaatccctccctctctctctccctcacacacactcacttgctcacgcagattcatgttagggttccctcccccctcccccctccctcttcctcctcctcacaccctctctctctcgccctccttttctccctccccgcctccctctccggctctccctatttcagtataccctggaatggcatggtatgaacctgtactatgccgaactggtcaccggccaatatgcccagtggtgcccattcggcaaaccatgttcgcatctacaccatcaatatttagagcatccaaacatctcacaaataaaatatgatgtaggcctacatgtagcatacttttaaacagttcaacagaaaataattgaatgagttagggcccaacatctcatcagctgcttaggcccccaaaatctgggtggtgtaggtgcttatgccatggtgatctaggcaaaggtcgcctaggcattctaacgtccatttaccgactaagtgaccacctgcaacaacaattgcaactaaatcaccaacaccaccaccacatagagattgagcatcacatccaaacatctcactgataaaatatcatgtaggcttggatacagaaaactttctaaacagttaaacagaaaacgattgaatgagttaggacccaacatctcatcaatttctaaagcatctgatcaacaaatacagcaattttcctaacctaaatcatcctaaaaacctaaaagtagtaatagatgaatcaacacactagctgcctaagctgagctgactgtccaaaatgaaaattaaaaaaaaaaaaaaaactaggacaatgattcatcaaaaattaaatatcagggaaatattttccctgattttttttgaaggaaaataattacaacttgctaatccattaacgcaaagatcaattaattaacttttttttctttttaggggtcgagaggaggtctagatggtttacatagactggatgcagtacagcaaatatcatccattaacttagaattatcatactggttaaaataggctgatatctagaatatcattgaaccttagccaggcaatgttccataattgtaaggaacaaaagattccttggtatgaatgacaaaaaatgactattatgaatgtgttaaaaagatgaaaggcagcaagaatgatgaggaagtaccatgcatttagatagtatacgaactcgaagcccacttctccaatttctctcatcaataagctctgtgacctgtaacccagtaataaatggagccttcagccaaagaagttcaaagcgtgcacatgaaatggaaaccacgtttgagatagaagttcagaacatacagctttctcagcatcctcgacagtctcatactccacaaatgcatgcagctgcatgtaaaatttaaaaatatatataccaacatgtgaatgaaccagtaaattggaaaaaaaaaattcatgtaaaatcatacatggattatatgttgatacatattttgattcagacctaattttgatcaagaaccgatctaaaatctgaaagccaaaacaacaaaagaacatacatctgaagaatggaaaaaactgaagaggggtttggttacaatatctatttatgcaagtatttgcacacataaaaaaataaaaaataaataaaaagaccattctttatttgtgctaaaaaagaacaagctcatttgcaaatttacttcatgattttttgatggattgataatagtttgccataaatctttcagagtttcatataaattggcaactacagacaaattaatgcactcatcactaatttccaaatgtgtgattactgaaaattaaagcatgctccatgttcacttgtatgcacacacagggatcatagcaaagtaaacaatagaaaatactatgccactaagttcagcatctttaagaaaggaacagaaagcatcccatcccttctttcttcgaaagatcttgggttcttacatttcccttttatcttctctccaactcatgatcatcaatgctgttgttgtcatcagcaagaatcctcctcctctccccccacctccacccaatccctccctcccaccctcctctcacgaggctaggcaggatcaatgacattttagagatcagactggcaaagcacatctatatggtcaaaatgcttgcggcagaagaacggaaagacgtctttgggtgggtttgggccacggttttgaacctaatggaacaggactaacctgaaaaataagcccatttattaaaaggataggtctcggcttggggattaaagcttggcccagcccaaaattttttaactctagatttttatgattaaatttaaattttgttgatatctaatttaataggagaagatccagattcttagagtagttattaagcattgaaattgctgttaaaaatacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgcaggccaggccgagctcacgcctaagcaaattgtgttaattattgggcaaagcccagccagtccaatgaacccatcttgtttggaccacttaaggagagaggacagagattagggagatggaggacaaagccttgatattggattcatgaagctccaccatggcaaggagagagagaaaaggtgtgtgctgagattaaaggcattctggtaaaaggggaaggggagagaagatcaagcggtggatgggatcaagatgaggtgagagagctggtattgtcatcactcagtaatcatcagtgaccacaacaacagcgagttcaagtagttgcctgtgcaaagcaatatggcgtggaaaatgggaacagaacaatgaaccacgaaaagcctgctagacatttccatttcttttaaaaaaatagctgacgtggcaacaccacctcagcatgccacatcagtaagttaagtcatatttaatagatctgcatgtaagagtatcactattcttaaaagattatagagtttcctgatatctcatttaattcaatcacaacttaggccatgcttggttcccaagtaaacctaaataaagctgaacaatataacaacttttcggctataaagctgaacaaaatcaccactttttcagctttattcaggttactcagccgaacaattttttctcctcttgaataaagccccagtaatgagagaacttttgggtttaacccggttaaaactattaaggaggaagcactgaatagttttatctgaataaaattattaacatatcaaggtaaaaattagacggaaaccacatacagccttaatcataaaaatctaccaacatagcagattttactctgaaaagttcacaggtggttccacttcatcataagaatcatgtaacattttaaagtagtaaatggttattatgagacaaaaaaaaaaaaatgccatttgacaaacagaagatgtaccttgttatagaaaagcatttccagttttgatgatctattaactgcagcagttgtgccatgggggttgccattaggattctgaggatagcaggtacgaattgttttcacactacaatagataagtttacaacataaatgaccaagattttcgtgacttggaaaaaattgacttctatatgacataaagctccttacctcccgacagctgaaaaaaccttcataaggttttggtagcaatgatcctcgggtagattttcagcaacaacgatacgtgactgtaaaggcaaaaaaaaaaggtatcacaaagaatatatataaataaattaagaactgatgacgggagtgatcgaataaaacctgcaattcttcaacatctccctcagtgaagggatgcaagcgtctaactttctttccatcatcactaacaacctataaaatgcaaaaggcatggtgtatcagaagagagtgtgcaagaagcattagcatataaatgtatcagtgacactagtgccagcaactagcaaactgctgtagaacttttctatatgaaagttacaagggattttgaatgaggaacaaaatgcaacatgcaaccagttatggaaagcagttgttgggaaggcatatgatcaaaatgaaggcattagatccaattgagaatctcactgaaaaagacttacgagttttgatgatgtctgtaacgcagcagcaagcaatgaattgttatggactaaggccttgatcttcttaaaagatgcaattactgatattggcactgcatcaacaacaaggatgtaataattataacaatgtcaactacgttgctacttttaaatctgatgttgattttatgtattagatcatgtgcaccaaactgcagaacaaaaggatgttcataaatacatcttgtaaggcacaattgctgcaggaacaaccacataataagagaaagaatagttttgcttgtctaattggctctgaccagtaattttttttttttaagaaaatagaggggatgagtggccccctaattgctctgaccattataatatgcattatttatcaccttccaccacaataatcatttggaatacatttaacaccagatatcaatgattccttctcagtacttaacaagcatggacaatttaagatacaacaaataaatggcccacaagggcttatcatcttcttgcagaatcacatgtatataactccttgcagttgacagttaaaagcaaataaggtggcaatttggtcaataaagtttcacccttattttcaattacccattgcttttctctacctagctttttagcccacatctgcattaaaagaaatgaactcaggattgcaaaatctcatgtcaacttcttcgagttatggagggaattcatcttttataccataaaactcttttttgctagtctcctttctctatcatacaaagtaaatcattggtagatggctgtattattcttttttcttcaccacatctcaatgattatggcaacatattgtattgaacagccaaaagataagaaactgatttaccacaaagtctactggaacataaccaccataaacagtgaatatgcaatagaattatttcattacctttcttccatatctcaaaaattcgatgtatatatatctaacagccccccacccaaaaaagggggaaagaaaactccacctccacctaccaaagccagtttacacctaatccatttgatgctatataactggattgtctattccaatgatactacattatttctcccttagcattgtcactcctagtgaaggtgcatttacaaggtacatggcgacaacacctatttaaaagattccataagcatgaatagttataaatcatactgttgaatgtagcggatcactaagtgtagtcacattgcaatggatcgtcattaagatgttaagagcatgcacaatcttgacagaacatgtgatcaaggactcatttatggtagcctaagagctgtgattgatagactattaagtcatttagggcagtttacactttttcaaaaattgataaaagacaatggttaaaagatggattaagttttacatttaatttacacccagcttatgagtcaacagtcttgtaacgcaatgacatgtacataacatcttgcattacatagtcagaactcaaaagcaaacaattaaaaagaaatgaacacaacattgataaaacagatgtccaccccttaaataacaacaaaggaaactcatttccatgcacaagaatccagaagtcttttccacccatcttcttcctctaagttgatcattggtactaagtaataatgctttataggtttctctgcaataagatttagattcgcattatatatttttttaacttacatcagagatgcttcacttcataatcacattactccagggtactcaccttgacaagtcttatgaaacatttgtgaccaccagtcaactcttttatgagctttataagctaatttggaatttggaaatcccttgatgatatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatctcattgaactctctccacccccttctcaaatctctcatctcccatctttctttttcttatccctaaagttccaatgaaaaaagagagaaagaaggaaaatcccctttcctccatggtaccatccttctttgctcggttcttcttctccactcgtctcccatcatctcctcccaacacctctcactaagccagcaccaatttcattgtcttctcctcccatctcaaccttcatatcctcaaataatgattcttctcagtaagaagaaaagaagaagagaaactgaaagataatcagagaagaaaaaagaaaaataagattagagaaaaaataattattattttgccagatcaataattttttaaaattttaatgccacataagtaccatataagcatcaatggttgtcacatcagactttcaatgaaagaaagccatcagaatagcatatgaaggcaatattaaaataattttagatagttcaaggactaaactttagctttttataatttagagattttttaagaatatccaacattgttcgaggatcagaaatgtaattgatcccaaaaaaattttgattcagaaaatctagaaattagagacttctaatatgtttatatttatattcaaaaaaaaaaaaaacccacactaactaccatggatagtcaaaaatattagactgattataagatttggttgattatttctcttgtgatgattggaaggcttaaatttggccacttgtttatttatataagcggtcatgtattggtagtttgccattaacttaactttatactggaacttatcaaaatgtaaggcagtcatttgcaaaaagaaccatttgaaagggagttatttatgtaataaaccactagaagccactatggtcgcttccaatcttctcttaggattttaagatccaaagtctttcttggcaataaatgatcttccatcaatcaatgaatgcaacacagtttctaccaaagaagcgaatattcaatctacatttttacatcggcattgagtcatccagagcaaaggctcaacctaattttgcatgaatgttgaagaactcattgtttgtgggttcaaatgtttgcatgccttaccaaaaaaaaaagaaacatgtttgcatgtagaggttgagtaatgaaggatcaactttgttgcacatagagtttaagtgacttgtgaatttggtcgtggactaaaatgattcgagtctcacataaaagcaaaaaaatcaatttactccttttatatgggatcaagtagtagaattggccatgtttggagcagcagagatgatttatttctccttttattgcttgcacttatatatccttatgaaatcaatttcattagtttgtttcacttacgtgtgagttattactttcctttttggctttactattgaatgaaattctcatcctattagaacttgtgaaagccctcttgctaaggtatggccaaatcttgtctcttgacttaatcgaactctttagtcaaaagcctcaatctggaattccaacaacctgatgtgtcaaagttcagtttccatgatatagtctataaactagtcctccatctcatgtaatctattggaagattttagtaacaacaaaacttctatttttgtaatggctagtatgggtctttatgtaatagaagcttaatgttaaccattatcatattttataaaattaatagagtgactgcttaggtaaaaataagaaaagaaaatgcctgttggactcaagaatcatgccttcttgaaagaactatggtggcctaatgttctacaagcattcactagcagaatagagcaacttttttagagatattaattagagtgaaccaagttaacgagaatgtggaccttatttagcattacttgttaagttacatgctcttattcatctcttgataaggtcattaatgctcaccgggtgactaatcttggcaattcaataggccacttagccaagccataacttaaaataatcatatcttttatttgatgcaaaacctacggcaatggaagaattgattctatttctgtaacgcataagtagttctgctcaatgtgcatcacatccaagtatatatcacaagtatatggattcttttgaattatttattttttactattttccttgaaaagaacttttttttgcaatgttcttagtttatacatacacctaagattcatgtaacaaattatttgtatggttgattccaaaaaaaggatatcaagctaagtttgctttattatatagaatggaaaatattctttactttttataatggtgaagcaatttcaaccatcagatttattggatgagcattcaattcaaaagaagttgttattgtttagggcaacgacaaataataaaccatgcgatacccaagcattttgaccaaaaggacatcgatatgccagtcagcatctctctattcagtaaatgcgttgtgaaaaggttttatgttccaattagaaagtgatagtttcacctttcaggctttgatatcatgttaagcaactaattgacccaaagtttaacaagtagtactcttcaacaatctattaactagattaaccatcaatttgggtgcctaacatcttataaattttccatcatgataattgtttattttggtaatatagctataatacatttatctgttatattatttttttaaaaaaaaaggtaaaaccaacctactttgttaatttgagatctctctcccggcattaagaaaaattattacatcatcaactcatgtagtgtgtgtgtaaagtacttatgtatatacacatataaaatatacaacaagagttgcataatttgttccttgcatagtggtacttaagaaaaatgagggaaaaaaaaagaatagagttggtgaattaaagtgctctcttcagtttgagaaaagagcaaaactccattctattcttcttttcatattagcattcaacacagaatttataattttgatatgttagattacaatagaaagaattcaaagaaattcaaatgtttgtaactatcctttcatgtgggctaggcataatctcttacctggtcactcctgtattaggtaagctgaatggcccacatcaaactaactcatatcaagagtatctacttgatgatttttttaagaattttctttataaagttggttatttgaatgaggtgaataatttttagagtcatctcaatctatttccttgctagtgcttgtacttttatacttttcacatgacatcagaatatattcatcaaagcttatattccacttagcattgccagtgccaatcttgttgtgtaattttgcaaaagtccatagaagtttgaaggtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcatgaacaggcctatgaaaataccactattgtttacaaagtaacaagcaaaaatgcttgattattatgattttacaaccatgactaagaaggattttgttaggtggctcattagatcagctggttttgtgaaggtatatttggtatttatgctaccatttcaaactaacagtgtgtgtgtgcatgcttgtattatacgtatccaatagttgcatgttactcaaaattatatgaagaacgcacgtgttatctatcttgcatattatttatggctcacccgagtctcaaaccggcctattagctcagttggttagagcgtcgtgctaataacgcgaaggtcgcaggttcgagacctgcatgggccaagtcgtaatttcataaagaaaatttgtaagttttttttaagtttttttttcttaaaaaaatccaagtcccttgcattctgttgaaaaaattcataatcattttcttttaagttttattgaaatattacataatccctttataacctcctgaatgttcttaaaaatataataaaaaaagatcattcataaatttttttccaaaaaattcatatttccttataaattgttaaaaaaatcatcatctcttgcattctgttctgaaatttctccatgttttatgtaatcccttctgtaacctgttgaataacagacttttcctccagcatcctgagtagcattttcatatctcgcaatggctgtgtccaagtaatttcgatgtagccgtcagcaaagtccaatttaccttagattgatggcttggaagccggtggcccaggtagttcaatgccactctcaaattgatggaatttctggacgagagcccttggactgcctagcctaggccatagcagattcaatcttaaagacctaaaaaggtttgacttcgcgcagaaaagatttcacagtccttttgttttatacgattcataatcccttgcgttttgttttaaaaattttgtaatcccttctcaccgtattcaattttagggcttgttcgggaaagataggattggcccaaatcttataaaatatgaggaggcatttttaaaccaaatccgttgaaaaatccaaacatacccttgagaacatgtttggatatctaagatttttaaacctaagataaaaatcatgatatgatataggatttaatcctataggattatacaaaaaattctattgagaaaaaaaaattcatgtaaataatcctgttctatgtttgactgataaattatgattttttcctcctccctccttcttcttcccaattcctttaagaaaataagaaaccataatagtaaacagaagaaaactgacatgatagtaaacctcttcagtgcatatcagaagtctgaattcaggatgttgttgaagcaaaacaaagagcaatacaaaaattacatgtaaaatagatatatagaagcattgaaaatagtgtattttctcataatgcaagcaacaattataagcatatcatacatggtaccctgtaaaagatgagacatcataatgatagagcaagataattagtggaaccaagctccaatttgaattataggccggcatgggcagtttaatgctatggagtatttccaatcagaatttttaaaacttgaaacatcatctgaaaattttaaactgagcaacagcatattaaataaactcaaggtaatgaattctttggctacaggtaaagagccattgctcttgttgagtctctgcccttcagttcaggttaaaattgaattatcatatgggccaatagaaaagcagggatatactatcttcaagagacaatagcataaattttttagcaacttaaagtccaaagcagaagacacatgaaacatcttaagagtataggggcctaagaatacagctagtagtataatgcatctataggcacatcatagaaattcagaaaggatcagcgagacaactaagtagtagattgtgataggttgtagaatagatgatgcagctatacaatcatggcaaaaggctaatctccaaaagagaaaatttagttctgtcagatggtgagtataaaccaaattacccatcgaaaagtcagaaattaaaccattatagttgctggtgtgaatcccatcagaatctttatcataggaatcattatatttaatatttaccatcttcactttagcataacatcaaacagttgatgagcaaaatttataggatatccaacatagaagagagtggagggcctcttcgatctgaaataagacattgaatcatcggttttcaaggaattgtgtcagctagagttgccgtagcagcgatggggtcaaaaaggccaccaaaggcaagcacaataaaagagcatggcggcagtgacagcgaggaggagggcagtaagatatagacagcgtgggaggaggtggcgagagggtagagaagtgagaggaggaggagggagagggtgcgcatgagaagaatgacagaaaaggagaaaagaatgtcatgtttagaagagaacatgagaggaacgaggaggaaagcccggcgatctcaggaaaaaaaatagatccatagagatgattatttttttcattgggattagccacttccaatagatttttaatctcatgattaatctagctaaataatagttagaatataaaataaaatttttatctctgagattctcaaattttataggatttgagccaatcctattcttcccaaactggctccaaaaagctcaaaaggcttggcctgctacaattttccccaggagattggaactttcctccaagaagccatttggctgtgcacatattatctacatctggaggctgtcaaataagttcaccatgagtagcttctcggtggatagttgtaggttgctttttttggttctattgcaaaactaatcacaataaaaattccaccaccagggcatgcagcggcggatctaaaaattttattttataagattaatataataaaaaaatagacaaattatgaagaaagaaaaaaaaataataaaatattattttttaaatttattattatttttaaaaaaataataatatataatatcttaaatattttttataataaaaaataaattaatgtgatctttttaggatataaaaaataaattgatgtaagatttaaatataagaggtggacggatgggattgggatggaatattaaaagataaataaaaaaataattaataaagaaagagaaaaagagagagagaaagggagagatatcaaaatggtatgagagaaggagagaggaaaagagaggtaagacatgtgaatcatcaaagaaagaaaatattggtcataattactcctttgatgtagtatttcttatcttttatttcttcaaaattttatatgagatatgaagtcaattataaaattaatttatttttttaatattatggggccaattttgatttttatttttatgttgtggggtcaatttttatttttttattatttttttaataataatttaatatataaatatatggattaatttttttatgggatcaattgatcctatatttttttctcttgcacccacagttgagtgcacgtgtgatcattggttgcactctatcttcgtgctaaatacttactcgcatcgctttgataccatgactcccactccctttatcctcctagagcttgccccacctctactagtgtaatataataatgcgaagatcatgctaatataggataatacatcatttgatccatataattcattaattatatcataatatattcatagtctaacaaaatatattatatataatttatataatataaataaataatcaatggattttagtatcctcgccaccatcatcgatttgaaaatcactgaaccattaatagccattgatctcgacagtctcgactgcgaacttgaaggcgccgagagagcctcgaacaaaatgatgctgttggaggaagctagtaaagaacaacgaatgcatgcctctctacccgtccaatcccatcacaccttccatccaaagattttttatcaatttatggttaattttaaaaaaattattaaaataatatcgagctcaaactatttacgaaaataatgctcagaaaaaaatcatcccttcacaagatgattttctttgccaactcaccaacctgaccgcctgctggaggccagatggataagagaaataagtcacctttgataaggcgactttataagttgccctttgacagggcgactctcccgtttcttcttttcttctttattttaagttaatatcttcatttattttactttttattaattttaaaatataaatataaataaataaatatttttttatttaaaatcaataaaaatattaaaaaattaaaatttttaaaaataagaagtcaaaacttgaattttagttcaatttttttttcaaatccgaaatttttaaaacttttcttcttcaaaacgaataagttaaagaattcaaaaatttattaaaaattattttatgatttactaatatctaaatattaattattattaattttgattttaaaaaaatatattttatataattttttatatagatgttagtttttttatttaaaaaatttttaacattcgtgtaatcacagcatctgaatgattttaataaatttaaataaaataaatttaatttaaaatataatatactgcacgtcatcacttattacaatcagattcagccgttataattatatagaaaaagtcagacggatctttcaagctcccagccagaggttggtttcacctagcttggaagtttcctgggttgcttgcagaagcaagctggcacccagccagcctctccagcatctggtcattgcgagccaatagttgctcgccacctatccgttccatacccccctctatctcttttcttattggtaaaattttgttccggtctctttcggggccccaccccaccccgtcccgttctacctctacaaaactttggtctctcgcggcctcaccaccatctctcccccactggccctctccttcctcagcccaccttccgtcctccctaattttctcttcattccagccccatggtccacaaccctggggcagcccgccggggccgggatccgaacctcatcatagtcggcacatttgccgtcttcgtcgccgccggcggtttcattctcgcaaccacaccactggatcttatgggccgccacctgcacttgtcgatggagacgcacctcgtgatcaattttgtcaccttcactcttgccctcctcctggtatacctttggatggtcggtgctgctacaagggcaccgtcaccgctaatctccagaaacgtagccaaatctttggtctctgtcaccctcaccgtgtcgctgacagcgctatttttcggccatataaagagagagaattttcttaggtcatataaaggtggtgcgagcagggagaatttaccgcgttttcgtacgtacttggggaataattgcatgaaaagggggcgtatttcggaaactttttttttttttccagcatctctaaatttgtttgtttttcttcaattagaatattttttagttgtcacgtcctcctgaccgccaccatctaagcataatatttggggcctctttgctaacaaaaatttttattccggattctctctattctctttcgaaaacccacaaatagccgcagatgagagagttgcgtgtgcctcggtgagttgcctctatcgcctctttgatcgcatacgtcttcgatctgctccaaggcccaaatcccttcttatttaaacttataacatttttttgacggtgttacgcccacctgtggtgggatctgtaattaaaaaaaaagaaaaagaaaataaaggaatactgttattagaataaagcattggaatgacatgattatatcgtagaaataaaatgctaaatcctgtacaaataagtacacagtttattgtttctgaaagagcaatcttagtggattagtagtagagctagcatcaaacaatcaaacaaaacttttgccattacaatagttgggtgcaggcatccagataaaaaagaagtgttcccacaatcacaggcaaactaagaagatacccacaaatgcaactgcagcatttccgttttcaactgcaaattttatcgcaagcaagcgaagccgcacacaaccaagcaaccctcaatccaatttctattttcaactgcaaattttattggaagtaagtgaagctgcacgcaaccaagcaaaccctcaatccaaatagctttctagccgttcatgcccatgacaaatgctcaaatatatggtggtggtggagaagaatttggcgtcatgcatgtgatggctcctcctctcatccagcagcgaacctttgcacatcatcactcaaaaaaatatttatggctttgaaggagttggagaagagggtggtttcaagtcggggtactgcattcacaaattaagtaggtcataagcaaatgcatcagttatttgtatgataagactccgtgactggctaactaggttttaggatttgggtcagggctcagggggctccttcaagaggaagaaaggtttacaagcacttccttcaagtactccatctatgtgaatgcatctagtattaattcacaaacatggatatatatttgaagcatttttatgtatttaatggaacccagaacaaaaagttcaatggtaagaagcagaagttgagaatcatacatttgggtatggtgacaaaggtctctcaggagcaagttttgcttctgaagcagtttccacagagtctatgtgatcatttcctgtattctggttcttgtcctgatgaatgcttgaagaggccagtgcccaaccattctcattgttctgctcatctgtcctttgactgttaacaccagagggatttgttgctttgctcttctttcttgggtaaacatgcacggatggtggaagcaaggtttcttgaatagcctacacaaaataacaacatcattattgctgccattttccttcattattaacattacaaagtaacagaagagtaacctgccatccatccttccctctgagtccacctttgattgcatatgcctctttgaaaccattcttgaacaaaagttcagccacttttaaggaattgccatcaaagctatcttacacaaaagaaacgatactcagcaacaggactgcaaaccacgcatgtagtcatggtgccatgtttgtcatggcatttggtggtgcatgaagcgagttttacatctaaacttctaaaatgaaaaattaaaagttcaaattcaaactcttcatcttctggtcaaattatctaaagaaaaaatagaaagaacttctaagtgtgtcaatcttaaccttttccatcaaaagcacttcttaattgtatctatgataaatgaagcaagaacaagggaagaatgaatgcaaataaacatagaccaattcaaagttcctttttcttttatcagatggtctgataacaagaaaggttgaaatataaatctgattcagcatgatgagatcatgaacaatggagaagatatttcataacttgttacaaaggattaaaagcatgaagattcatgcatgcatcatatggtcataaagcagcaatagaaaaggatgtaaaagaaagtttaggcaagatatggcaaattagattcaaggaactactagcaccataaaattgtggaatactgtaaagagacaaagattgagattaatggactttggcagtgtgtcaggaagctcaactattgagctcagtgaaattaataaaggcacgattgtgaattaattccaagatcattcaagatatatgtggcagagtaaaaagcacatggtaatggctagaacagtgactttccatatctagcagtcgaataacaacaatcagctgagttttcatcactatgctcttcttgtacaaaacttgtccaccggtattcaaaactaaaccatgtctaaccaggagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctgactgaagcatcggaaggtctccatcggacaccatttcagtctgtgtaaatgctgttttgcaggtgctcgttaccgatgacagaggacggggagttagctgcaacagattactattggtaaatagcggacgacttgagctgatggtatgacaaaattatcaaccgacggccacgcctactaccgacgtatggtcggttgatctgctcaacatgccataccgtcacgaatggttatcgaccgcatatcacggtgcaattagtgaaaattaatgacccactacgtgattatggtccgataatttagcgtcataaaacacgggaccacgtccgacggttacaagaacctcatctataaaaaagaagtaagtgaacaacaccgataagccacttttgatcagagctctgctacactgaatattcaacaactactgttcaccaacttttctctctgacttaagcatcgaaggatccccgccggacaccattccggtctgtgtggatgctgttttgcgggtgctcgttaccggcgacaggcgacggagagttggccgcaacagattgacgcgccaggtaggggttgaggtccacctcggttccttggggctgaagtccgcctcggctgactgtgggcctcctcggactgtacacatcggagttctccttgactgaggggctctgttgtggttttaataatatggagggcactaatagtctcacatcggttgtgagtcaaggaagactcgcgcttataaggagaaaaaaattcttcccacatgaggtaccttttaaaggacaaaaccgtgagactcatgggtcagagtggacaatacctcacatgacggatcgagcctttgtccgcaacaatggcgcgccacattgattgtgagtcaagagagactcgcacttataaggaggaaaaaatccttcctacgtgaggtgtcttttaaaggacaaaaccgtgaggctctaaatgatcaaggtccgttgaaacctaaaggcctactgaagcctaaagatggtcatgaatcaaaacggacaatacctcacgtatgcggaggcgaagacataagccaaccatctgagccattaaccccttaacccataaccacaataaatccaataggaccagggagagtatgtgaaataaaattttagagggcatatagaattaaagcaatactggttgaatagattccaaacagaaccataatatgaccttatcacattaacttgggtttacagtggaagagaatggagagatggtgaatacacttctatcagagcaaggaataaatgaggtacatttgagtgtcatatgctccctggtcatttatatcccaatgatatgatatgggaataatgtgcaggaataatggtaggcatataaaaaggtccaagatccaaatgcataacatagaggtgagtatgttaagatagaagcattgaaaaaaatagtaaaatagaataagcaagcatcgcatatcacataaaagaaacacaagaatttatatcagtatagtataaagttcaaccaatgatatatgggcatatttaaccaagatttcttgtaccggtaccggtggccggatcgatcggccggtggtacgatacggcacgcctccgttccgttccgaaccgagacgaactgacgaaggaaaccaaaaaaggaaaagagagaaagagagagaaataaagagagagagggaaggagaaagaaaaagagggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttctctctcttcctctctttttcttcccgacaacagcatgtaccgttttgcatgccggaaccgtctcggttccccgccgggacgattcggcacgccccataccaggcggttcggcccggtatggcaaaccctgtataatttaacaataatcggaggagacccaagtctgaagagagaatagcaccgtgtcgaaacatcaacaaagtaggaagaatatcacaacctacatgatagtaatgagaaagaatccggagaaaacctaatttgaaaatatagcagtagttcataagcaaatataaaatggtcttgtaaagccaaccccaaatatatgggatagcaattgctgatttattggttgaccatatcgaaccaagaatgttccaaaaataaaatttgaacatggatctcagaacatggttctggtgaccctggagctgatgcaaaaaatctgactcagtttattcataacatggctgtgagaggtagggaatgatagaccaaatgccccaaccaaacatctatttatatcaaaagcaggacctcaactaaatctgatttatcagtgagacaaggtatggtctccttcataaggaaaaccaaaatcctatcaaatgaagatcatttcacataaaaataagcaatatgaagaatgtacttagattcatccattatataaataccaaactacaagaattttcacaaatctgtttatttcatccctagagaataataaaagggggaaaaaaatcaatggctaggtacataattttagtgatttcaagtataatcaaagtataacacaaattctttaaagatcccatacagctgacacaccaactttacgaacatttattcctcaataaaatgcacaaattacaaacacagctctcctacgtaacaagcttaaaaacaagcagattttgacacattaatcaaacctcatgaagccgcaagaactatatgtttccattcatcttttttcctcctattttctcagcacattaatcctgaaagcaagtctagaaatcctagaattccaagttctgtattcttgtccgaacacattcatgctcgcataaaataaaaaaaactaccatggcaaatatgaaaaggtcagagaatatatcaatgctcacttgtcaagaacacaaataatggtattcccaggatccctaaacttcttcacaacctctttcacgaagccctcttcttccccttcagcgaactccacctgaaccacatccttatcaaaaatcttcaaattgggtgaacttatgaactgaacgctctgcttattcctaatatccagcagctgtgaattgggcacatcccttagcttccgaaaagcatcaatggcgctgatgtacttgtacttctttagatacccttgggtcagcggtattacgaccagccaaatgaacgtgactccggcgacgaagaatgggttccggttgaagaaatcatcgatcgagataacaattgcttcgatattgatcttatctgaagcagaaagctctgtttcggcggcaaaggaagggaatgggaaagaaacggcagccatgatagcaagagagtggtgaaatttccaaggattgttcatgaacaccgagtcctgaagaggaatttggagatggtaaggtaaaattttcgagaaaggtgcagtcttttgggcggaaactcggatggtgagagaatttgggaagtgggaagtatagaatttgaaaaaaggtacgatcttttgggttgggaaacatttttggtgagggtttggagcatgggaagccgagatttggagaaatggcgagggctttgggatcaaacggtggtcttggagaggaatcatgaggcaagacgagagggaaagaaagagaaaatgcggacgtggcgcgatggagcgcgtagctcgctatccataactggaatctggatcaacctttaacccaaggcggacgcttacggaatgtccgcacaaaaatttctatacgtacatatctgtcctccacataaactgtgttgcaagggtgaagtgattggttgaaataggagaactcaaaattgaaataaataaatgttacatgtgtaaaccataaacatacattacttaaccttctataaataaagaatcaatttttatatttaatgattagtaacataacttacccatagaagtattccacatgcataatctttgaactatatgaaagtcgtttattcttaaattttctaatttaaaaattaacactaatcaaaagacacatgcactgggataggttttcttatttttaggtctatttcatgtaatgattgggaggaatttctccaggttttacagtttgaatcaccagtaaaacatgagtattgatcagctctcttatgttatactgctcattgcatttggttggcttgtaattttcgcctgtttgatactccaaacatgtccccagttgtgatagcaagacatgctttcatttccaactctctagatgctcccaaagtttacttaacggtcactaggatctggttgttatagaccccttatcctctcccacttctatttgttggtgtcccctcacagccgtgcatcctaaagatctagtcttatggtgaagggcaggcagaaaatgttagtgctagctttgtcccgagagatcatcaaggaagagccattctcagggctggtcaacttcggggagcttgggaaggtgcaagtgcattctttcatttggatcatgttggtggctttcgaattgaaggtgattcttttatagaaatttcttccattaatggcaaggacaagatacatattcctcatcacccatccttgctagacatttagtctatagttcaaagggttcctaattttaaagccttgcattcacaatttgaaggaaataaggtggctgattgacttacgagaaaggcaactagtttagatgaggagttcatatggaattctagtgatgaaatgttatttgttgtatgctgatccctcgtatttaagctttttaaggggatcttaattttcagtcctcatccaggaaaaaaggggttcaaaacatgctagacttatataaaagatgttctaatgttgatagatttagaatattctcataataatcttaattttaaaaggtttaaaaaatgcccaacttctgcagaagaaaagattctaaactgtttgactttgaggataaaaggagtagagacggtaagaattgccacttcatgctgacttccaaacccacaagtggaagtttttaaaacaaaaaaaaaaggtgaaaaagaaagaaccagaaaacttctaaaaaaataccttagtctatctgaaaagatacaatagtccatctgaactctattaacttttgaggttggaggaagacttggaccaagagatgaaacttaaatataataccttagggaaaaaaaaatacacatgagttgattattctcaagtctttttagaacttatagtttagttgaattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacatagttactgaagcccaatgctattgagattttgtcacttgttaggtcaatggtgcaaaataaaaactaaaggtgatgaaaagctgacttcagggtaacatgcaaagagatatgtgacgatgcaacttgtgcaaaaagttttgaaatttgaaggtaatgtgtaacaatcgatacttcaaaggtgtcagaattttggaccatccaatagctgaaaatttggtgtattctaaagtgacatagtgagggtgactgatgcataacaattaaaatgattcaaacttgtagtatttgtcaattgcaaaaagatcaccctggttagacatgcttagtttaatcatgccttcattcaacactagggcagtgagcaaagtatgtgattgctcacatacaataccttcaaatcgacagttaattcaccaagaatgatgacttcactataatcacaaattgaaagaatgcaaatgaaaattattaatgaccatgaagaattgacatgagaatcattgctgattgtcctgtatttcaaattgtcatccaactttcctgtattgcaagataaatgagcgtattgatgtttctgttcacactgaaactgaaggtttcagattaatgccaatcaaggaatttctctacacatcagggaattacgttccgacaatttatatctggagaagacaattagcctattacaatttatgaacaactatgaagagataagagatctcctgattatgtcttcattcacaggcatgattggtttatgcaccttttccaccttccaagcttctcccttccctggaaaatgattgcattagagttccagaaactacaaaaatctttcacaagattataatcttaataacgtatgcctaaacccttggaacactgctattctaaacgagggcatagttcacatgtgtacttgccaaagcaatttagagttccagcaaacaatggccctggttccaggactctaaattaccaagccactgttaccatcaaagcctgtcaatgtcaacagcagcgccaccattgtcatgggccctcagaaaatcacatacaattttaaaattctactccattcaggaaatctaagtaaaaaccaacagtcagcgaccaaaacagagtaaccttttgacgtgcacacagtcaatagaaggtttgtatctcttgccctgaaagcagtgcaagtctcaaggaccaaaattgcaacttagaggccgtctgcctactggataagagttcatattgttaacaccaaatatttgccttcaattataattctgcaattattttatatgacattgttccatctaatgctaaccagtgctggtgattaaaaagtggaccctggattctgaagtagctatcggcctgagaatggatggataggcagtctgtgcttagtcaatggatcagttgaatgtaaaatctcaatttgtgcaggcaatttctcattatttttaccattgtatcatttgacagtacaatcttgtcacttaccccatgtctcctacagtttgtgattccaccgcaatcaagaagtcatacagcaacttttaaaagtgaaagcaatacatcaaacaaaactggagtactggacaacatcttcaacttgacaagcatgaattttccccaaaaagcatagtcaagttacaaagtgcacacagcataccttgcgtgggccaactgccagctcattatctacaattgaaagagccttgaaacccacacgattcaataccttctcatagctgcaagaaagtaaaagtattggccgctgtgtcattacctcagaaatgttactacttttattttaatgcaactaagtgagggtgtaaacggataatccaaaggtgaagatacacactcagctacagtcacattgtatggtggtcctttgtcttgatcactaatctgccattaaaaaaaaaaaaattcaacaccacagtcataagatggttgatatcaggtcaagaacaaattgcaagtctgctaggcccatttatcagccttttcagcatagaattgtgctggtccatggagaaagtgatgaagataggaagagatgtgaatgatgaccgcaaaagtcatgacaataatgaccgcaacttctatttacacagaaaacaaggccacattattgagaactataagaagggctctcaccaaatatatcagtgcaataagctctccttctggttttaaaagatctctaacttttcttgcccaagctgccctcatgcatggatcaattgcacaaaagaatctgcagtaaattgcatatatgagcttcttataagaaaagatatgcaataaatggttcatgagcacaaagatgataacttacgtgtaatcaaaaataagatcaaacaactcagttggctgccaagtgaaaaatctgctaccagaaatgtgaaataatttgcatttggcaatgaggaagaccactggcattgacttgatgagcaaaacattagatagatgcttgagtaaaaacctaattttgcaagagaagctcatgtatatgtcatcattcatctcaattgtacatttctgagtagcaaacttttaaaggatcggatttactagttgagaatgttccaagaatctggttttcatctcacactaaataggtcaaatattagccactgtcaaatatggttgtcagtggttgatgacatctacctcagtaaaatcacaagaattttgtcacttaatttaaactcagaaattatgtgacagcttaccacattgagttgtcatcaactgaataaatccattatcatgtaaatatatgagcaaacaacatgaatcatattaaaggtaaaatatgaaaatggcaacaaagtaaattcatcaaacagttccaatatctatgagattttatttatgacaaagtgtattatggagcatgataggaacatgcttcaaaaggcaattaatccatgagaacttttgcttttgttttccactaaggaagcatattgtcactataaaaaaaggaagggcatatgacataagactggatggcaaaaaaagtgccataagaatctctctctttctctctcatctctgttcagcaagagagaaaagagtctttagctctactacacattaagtcccctccatcacatattaacaaagataatacatattgtgccatgaattatcttaagtcagattcatgataactaatttaggtaaatagtttgggtgtttgagtatcaagtgagaaataaggatggagagaactcaatggtaacaaaatgtaaaacatccctccaaagtcattcatagggcagtatgctgttaacagcttattacatagacagtctgcaatggaccacaacaggtctaatgtaacataaacaaaacatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccttcaatttctctgcccaagctgacctcatgcgtggatcaattgcacaaaagaatctgcagttttacatttggtatatgagcttctttaaggggaaaaaaaaaatgcaagaagccaaccggcctcatctcagctggttggcatttctctccactcgggagtggtcaagggctgggtgctggcatcctaaaccggtttctttgaaaaaaaaaagaaaagaaaagaaagaaacaaagaaaagaaatacgcaagaactgggctatgagcgcaaagttgaaaacttactggtaatcaaatatgagatcaaacaactctgttggctaccagaaaggtgaagtaatttgcatttggcaaagagaaagaccactggcattgataaaaagataaaatttacaatatcagatcttccattgaagttatgacatagatatataggtagggtgtttcctgtgaagtatcactacgtacactaaaatcggcaacggcccaccgaatatacgataaatgtcgcactacacgtcacatgtcaaagttaataatatcaacatttgaaagggtgttttctgtaaaatgctattgctgatttcaccaaatttacatgaaacgcccgatctatgtaaatattacacattagtctgtggtacggtgagttgacctgagaatttttcataaaagtccttatatggtgtgtcaaaataactaacagtcgcatcttgctgcgactttaccatcgacccaagcagttgtttctccgttcccgcgaaaatcgaattcgaaaaaaaaatgagaatttccgagctctctccggaccgccggccgagctccgacgactcccagcccctccgcctcctcctcgaagacctcgagtcctccatccaagaagccgaatccctttccccagacgacccctcctcgggtgagaagctcgtgaccaggctccggcgttccctctcccgcctccctgccgccctccccctccctgaacccgccaagatccacatctggaagctcagctaccgcctctggaacgcttgcgtcgacctctcgaacgccgccggcttccgccccgacggccgctggaggaccggccaggccgaactccgccagatcgccgccgacctcctcctcctcgccggaaaccccgccgggatcccatccgccgccttcaaggctgcgtccttcttccacaagactggtcagatctggcacgaactcggccggttcgatctcgccgccggctgcttcgagagggccaccgatctgacctccacggtccccatcgacgggatcggcggcgaggaggagctgaggctcctcctcgatctcagtctcgcaaggtcaaggacggcgtgggaggtcgctgatcggaatctcgcgatcgctctcctcaatcggtccaaaagcctcctcttcggatcgcctgcggcattccgagccctagcggagcagtacctccagttcgggaagctcgatctcgccaagaaatcgctggaggggaattccgatgcttcgaagctgctgacggaggcgctggatctctgcgagaagggaatcgcggccgccaagggccgcggtgatggcggaaccttagatctggaggagttgaaggggcggtgcctccgattcctggcagcggagcgtctccaggtggaggactacgagggggtgctgcggtgcgttagggttctccgggtagacacggcagtgagcgccgcagcggcggagcacccgagcgtgggtttcgtggcgatgagggcgtggctggggaccgggcgggtgggggaggcggagagggagctcaaggggatgatggcgaacaaggaggtgccggagggcgtttgcgtcgccgccgctgaggcgtacctagcggtggcgggcgcggaggcggcgcggggggtgctggcgggtctggtgggacggtgccgggccggcgccggtgcggcgctccgggtggtgaagagggtggcggagggtggtgggggagggcgggcgaaggtggtggcggagctggcggcggacgagagggtggtggcgctcttcgaggacgccgcggcgacgaaggagcggaacgcgatgcacgcggtcctctggaactggtgagcttaccgcaccccttccggtatcgatgtggtcatagttaataacttccttcttcccgtatgaatgatggatacagtgcaaccgaacattttcgatcaaaggactatgacataagcgcagaaatgtttgaaaaatctatgctttacgtccctcgtgatgaggagacagagctcggcgttcaaactgcttcagggtccttagcctctgccaccttgcactcatgcagcttgatcaagctgaagaattcatcaatgaagctgataaggtatacgttttcgataaaattagcagaaaacatcaacttgaagccattactatgaattctggaactatgtctgacccttgaatcctcccttgtcctgcagcttgagccgaatgtgaagtgtgcttttcttaaggtaccatttcgttgtctcaattccatcattagtgataatattagcactgcaattattggagctttccaaattattaacaacagtttcaatgtccatatggttctctgaattattctcagtactgaatttttcaatgcatcaaaaattttatgaattacttacacttgttcgagcactcgcgaataacgatactagttagtagtggtattgtagctgttaggcatcctccttgcctctctcatgctagtgtttatccaaattctgtttggagggcgccgaattactgctctttgttgaaactgtgcctggattctagacctatgattatgaacttcagaatatcacaaaggaaacataggtccatcttcctgcttttaatcaaagtccattgatcttcctgcttttaatcgaagtccctaacttcatgttaatccaatactgtgcagtttaagatctatttgcaaaaaaaggatgagaaggaagcgatcaatcaaattcaagccatggttagctgcattgacttcaacccagaattcctcaccctttcgacccatgaagccattgcatgtcagtctcttgctgtagctgtcgcttcattatctgtcctcctcaacctctactccccagggaagccaatgccaatgccaatgccagaggtggcagtgctccgaaatctcatcacccttcttcaaaggaatccagatggggagattgagatcctcaaatacacaagggttgctggggcccgaatgaccgggcttggagtggaaggcttctttgggacaggagctgttgggagccgtgagctaaactggtttgcggggaattcatggaatatggggctgaagactggaaaggagaagaaatatgaagcctgtgccgagttcttggagctggcatcggagttttatagcgtattgaatgatgagagtaatggaaaccaggtgatggtttgcaagtgtttgatcctgagtgtaggtgccatgctcaatgtcgaggagcaaaagaaggttactttgctggactctgatatcaaaaaggccattgaaatgctcggtagagcaggcaaggtagtcagaatttggagcagcttatcatacttcaagaataaattgtaattgaatttgatctaattctcaattgcatgcagatactccctctagtctcatcccgagtacaaattgtcaatgatcatcatgctgaatatcccgacctcttctttctccacacctacaacacctatcatctcctgagcaggctcggcaatgacacccggtcgcagcaactccaactgatcaagagcttcgcttcgtcaaaagtatgcaccccaaatcatctcctccagctaggcttcactgccttaaaaggtggaaggcccaacctggaggctgctgaatttgcccttaacgcctgcctctctgcgctccttgcatccccctcgcctgactatcatttgatcagcattgcgctccgaaagttagtctgtctttctgggctccaagacactgaaggtgggaaaaatgatggggcctaccgtgtttacaggcaggcataccagatcattgtggggctgaaggatggggagtatccaattgaagaagggaaatggcttgcaacaacagcatggaacaagtcagggttagctgtccggctccatcaattcaatgttgcagagagatggatgaaaatggggttggatttggccagacacttgaagggcatggagaagtatagagaggggatggaggagtattttgcaaactttgaaaagctttgtggtggtggtgtagttgatggtagtggaggtaacgaggggaaagagagcagcagtggatctcaaccagtcttggtatagacattgtcaagattttgttaaaaaggaaagaagatacggtcaccaagttgattcaaaattacatgcatgcaatgtcttcgtattttcttccatgacaggtaaaggaataagaagttggtaaagatttacaggcactgatatgaaagaggagtaacgtttgtccatcaaaaaggaaatagtagcatttgaagatggatttgtaaataaaaattcaaagcatcccgtgtcaggactcaggctgggaaaaaatagatgtcttttagtgtgtgcaaaggttcaatgaccaggactggagactggattccctgcagaaaagtgtccgtatgctattgtaccggcattttttgttaaatcgaatcgaactagtttcttagttagtgcttttaccatttcagcttgatttttgaaggttggaatttcagtgttattcttcaccatgtttgaactgtccttcccatgcctttttcaccggtagaaacaaatggtatctgccgtatctgttttgcaggatttctgtgaatctaatgtgtctctccatacattcgggtaccaaatcatctcccgaaggaacatgtataagtacatagagagacaaaccagcattgatattttgatctgctgaagcttttgtgttcttcattttgaaattgagagctgaacacccacaagtttcgcagcaaaaactgataagagtgatgtcaaccctcagatatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcacttgtctctatttcctaatcttgttctcccttcgtggaaaggaaaaactatgctatgcacatggagattgttcagatggttatagtcctgtcttgatgcatacatatcaagttaatatgtattgaaaaaatgcaatgttgtgaatttgaaaagtggcaacatgtcaaatttttatatatcaaactagactagtttaattcttacagcttgactctgatgaattctgcaaacaaaatggagatcaagattagcctgaacatgcaaaattcagaaaagcaagtgtctggattaatgaaatggaccatcaattagtaacaacatcaatagattattgaagtctttgacaataaaattgcttgacttacatcaagcagaagctattatttcaagtttttctgaatcgaagtaaacactacacctaaaattgatggctgtacccactccataacaatatctccccggttgaagccctgtcagccaacgaatgaggcactccctgtcagataaacctcaatcagccagttggcggagcctactgctctaagcaagaacctgggtccattggagccactcgaccaggtccagacaatggtgcagcagcaacccccctttgattcagcaaacacctgaagcgagccaatcttgatgtgacttgttttggatcctttgccagcttttcaagtggagtccatagccgctcttgggccacaaaaagcaaatgctttagtccgcagatctttcaaagaagcaaaatgtaggtacttacagtgacaaacttgcacttgttactgctaaatatgtatgcatatagcaagattaatttgactttgcgatgacaagcgcattcaacaacaagaaattgagacttagcagtcaatggcttttacgctggtgctattatgagttcattactgaaggaactaatctgccttcatatgtatctttctttcataggaaagccacaaagtatatcacaacagatatggtgcaaaatgtacagattaaacacacggaaatcagactacatcaaatggctggacacatattgatgtcacatggttgttgcagattgtatgtcttctgatcacatgtagcaaactttgtttactttttatcaacaaaattgtgcatcacataggagtgtattaaaggagaatttaatttgcagatgcccttctaagatttctacattcatgcactaaattagaaagaaatttttgcttatctagtcatcttgaggtttctgaaaaacatcatcaaaatatgcatgcagatttgcagcatgttctatgcaattaagcttggatttgtatggagattgtgaagaaaaactaggtgtggaagtgtaactacatgtgcaggatgaccacatccagaatgagaaaaatggtaataataaaatttcagcactagttttaaaatgttgtaggtagtggtccagcagaaagatgaaattgaaagcaggctattttcagacaaaatcaagcaatcagagatacatggaaaatttggtacaacacaggctatctttcttcaactggagacatgattggacatctaagtttgttattcaagatcttcatgaatgataggagtataacagaaaatttagccaatagggaatattgaatctgcaccaaaattaattgttggttcatcatcttgcaataacaaaaagaaataaagcactaatccaactaaatacctgctgctgctgcagcacgtggccatatagtttgctcaatatccgaggtatctatgtgttctccccacatgcatacttctccaccaataaccagtttctgctgttcagggttggaaatatttgtgagtggctcattcatatagaacttcggccatgtggtatctagatgatccaagtaccaactgtcctggttgctgacaaggcaccttagaccagcagcaaccacccttggggccactccaacaccaagcctatcagagtgtaagaattagactatcatatgtaatgaaaagacccgaatatgtcataatcatgaatatcaacttttttctaagcactgataagtgttacaggatatgaatgtcctatgcttatatagggttttgtggtttgatgaagagtggaattcaaaaggcgagcttgcttttgattttttttcaggaatgaccactgtatagacgcagactgttggaacaataagtagagagaataatgagaagaaattatgtgattattcctaacaagtctataaggccatctcaaaaccgataaactaaaagtctagaaaatttaagacatcgaccaccacttcatttgagatcctaaacttatgcacacttgggacaactgctgatgccaacagggaaagctgattggctgtctctgaagttaacatgggaacatggtctacagtaccgccctgtatggggcatgctgtctcatatcataccgacacttggtatgctgtctcgtactgtactgaaccgcatactgacacgataatagaatgatatcaatatggggtccgatgccaaagtggtgaaccttgtatgtaaatatgtgaatcatgctttgttagcttcagatttttattggcccgataacttaagtcttcataaatgtttatatattgccacaaagtaaaaacttaaaagaaaagcataaaaactgaagtaaaaatttaaaagtatactgcaccgtaaatcacaatcccatttcaaatccattttaaattaaagcatctctcagagcttggttcagtccagtttcagggtaatatggcaccatttcgcctgatatgggtggtttgatccctgagctagatataaaaccaacatgcattctctggactaaacaatatttcttgcatgtatcttcatcaagtagaatggcatcatcagtgattcaatgtagaagtcccaaagaagtgatttatttctaaattggtggataagtgaggagtttaattatgggtgcaaccttatacacttgaaaatagatgaatactatgagcttgttacaaataggtgttctaagcttagttcttgaaaacagatgttgaataaatacatcagtaaatggatgagtgaatagatctatacctctgatatggatgaaataattcccacaattaaacatagatgtatgaataaaattgaccaatttgatgttttaatctttcaaggcactattccaagacacatggattgattaacatatgttctattatacttaaggacatgtcctgcaagctagaaaactataacatattcccagtaataacgcaggttcttcatagccagacatgatggttaaaagaatgcttttcttttgcacattaacaggcacaacaagatatcttgcattcaataatttagaagagataccagttatgcaccactgttttagggctcaatttgttcccgaagttgtcgaatgtctcctccctgttgcccatgcaataacatattttagagcataaaaaatttaggatgcataaacctgataaaatgaagtttccttaccaattaatgacttcatatccatgtgatagtgctatcttttgggctcgtaagacaaagtattgataggcatcggatccattcatcctatgctttttcaacctgcagaaaagaaaattgataagacttactagtgcacattagaaaatgctaattttcagaatgaacaccccacgagattacagtaagcatcacaaagcaaagtagagctctttatgaaatgtaaaaagatgatccgaagaaatgaagcatcactaagaaataatttttttcttttcacaaagaaaagtaggtttccttatagaatataaatataatccacagaattgaagaatcactaagaaataaagtttctatccaaccagtcttcatgatacatatatagttatcaggttcactatccaaagtgttcagttaacaaggtatatgatactagactgcaagacatgacagtcatatagaaaaatactcttgttattcatgaactttctattagcaaaattgtctatgtaactactcctgtagaatggaattgtttacagggtactgaacatttaagatttttcagagacttattcacaatttggtcatgaataaattattggataattgatacattctgttttgccttttttttttttttgctactgtctttaccacacaaatttttctatataagcatatgaatattaattatcatacatcttttctgtttttgcaaatattttctgattagtcaatatttcccttctacttgaactttggcagatctcctacaattttgtctagttctgaacatctagatttaggtaatgattgctttcataatgagctacaatggttgcttgtccaatctacagtttactacaaatacatgtcatgtaatttcagtgattacaatgagtctactgtaacagctatggttggaaggtaaaggaaggcatcttcacctacttgcagtggcatagattggaatgcataaaactcaagtagaaatattgttctattgtggcaagatgtcaactggaatccacaaaaatagtgtatgaactacagtgaaaatactctgaaactcaaatggaaattcagtggcattaacattaatagactaataatgcttccacaaacataacagttttgatggctcttaacagtgagaagaaaaaattatcataaggaaaccacgtaagaaaaagcagtaaatatgaatcataaccaggtttttgtgttattcttggtgtttgcaagtattctgcaacatgcttttcaaagtttttggcactttagacaagagcaacttcaaaagtcactgggccaccacaagaacatcttcccaactaaaactgctcttgaatgagttctctaggtttaagagataacacgatactgggagcaatcatttaagtcttttacttttccgcaaagtcagcattctcattcaacaaaagattttcaagaatttctctagatcgtgaccagaaacatatatcttcagaaaatggatgctcagtatttgagtattgcccttttttaaggaaatgtaggattgatcatcgaattaatgagctaagaagaaaataattaattttcaagagttgatttgacatacatattctacataaaatttctatgcatcatggtgatcttaaatttatgcatggattgactacaatgtgtttgaagtagatgatgcttgtttaggatgtattaatgttcaatcagtatttcgagatcataatgtggaagatctggatgctcaaattcagttatagcactgcacgttgtatttttatacaaatgcaatgttataaatagctattatgtggctatcgtgcaacgaccgtatagccttcacttttctgaaaattgatgaagagactagcatatatttggaagacaagtgcatatatataatgttcaccattaaattgcttacaaagaattgtttttgcaatgactttgcgtttggattttttttctctttttcagatcatgattccatttccatgttctgaaattttgagccttgagtctagaagttttctaggagatgataggctgcttaagactttgaaagtcatatgatatggagagaaaaaaattgatatggggagttctacaaaaaggtagaaattcccagattcatgatttcaaggccttgatgaaatttcattgcaaaatcagacacctagtataataaaatcataacttgctatcataaatacatttaaaatcatgaaaaatcatgatttattagatccaagtgcgccgtaagtaatcagtataaagactagtagtttagtttttagaaaattggttttgtttacatatattacgggtgtatggataaattatataagcgatcgaaaggttggccacatttttaaattattttccaaaacttaaatcttcaaaggttttaaatttgtttgtttgccatatttataacgcatggaaactacaaattattttctgcatctagatccaatggatgctagtgcatggtcgacatgtggtgctatagtaacctgagttcaaggacagtggaaccatcttgaaccaccctgttcggggcataccgagcataccagcagtagaaaaagacagttctagccttcaaatcgagaggttggcaaaggagggggagagagagggagggagaggaagaggaaggaagcagagaaaaagaaagagggagagggcagcagtgagtgagggccaccgaaaagggttgagggagggagctcctatttcgaaagaaaataggggcttcggcccttttttataatttttttttgaattttttaaagtgaagtcaacagccactatctatttcacttattatttttaaaaaatttttaagtaaagtcgatagtggctgccaacttcacttcaaattcaaaaaataaaaataaaaaatggccattagcttcaccttaaaaaattcaaaaaaatatatataaataaggggctagcgcccctgtttcattttgaaatagcagcttcatccctattccaacacagagaggagcaagggcttcaaaagccccctcccccctctctcggccttgctctagtggccctcactcaccaatgccctctccctcctctcctccctctcccttgctttctttgtctccccctctctctatcttttcctatctttcctccctctccttctccctttgcctcttcctctctctgccaccctctcctacaatctcccttcctcctctctatctctctccccccctccctctctctctcaccagtttccctatcggttcatgccggaatgccataggggcatttaccatatcataccatcagcctaccagcataggtgctgtttccagtactacggaccttccttgagctagcattacattcataattttcgaggaactgttgaataccataaaaaatgaaggcatttactacaaataatatgttagttttggaaagtttattcaatgtatacatctcttttaccaacagaagaaattacattgcttaacaacttccatcgctaatactaatctatgtcatgattggaaaaagaacaattatgtcacagatgataactaagcctcactgtgatgtatcaaaataatagactggaagttggagttatgcaaatacataccattgatttacatgaggggtggaagtccagcaacctgaagcccacgtttgaacaagtaagtatacatctaattgccaatgaccataggattataataaaaaaaagtgcttccatattcaactttgataaactatttcttagtaatgtctctcacaggattctatgaaattagttgaaatttgaatggaaaagacgataagcaatcatataaggactggctattaaatacctcacaaaatccaaggatctaaggatattttattaagagtagtaatattaaagggtctttgtccctgaaggatgttttaagcatgattactatcatcatgagaacaaaatttcacgtgatgagatatgcaaaggtatgatgctactaccaggaaaggttataaataaaagaatttctcaaacttacttgtgttgacttcatcaccgcccaaatggacaaatctgaacttaaaaaccttactaaaatctgaaacattgaacagaaaattaattgcttttgtgacaattacaataatcaaaaaatttactcttttcatttgagataaagatattcatatattatgtgcctaatcaaaagaggcaaatggaaattctgtgagcaacataattatgcatcaaagttacagaattttgtcaaatctatccttcaagaagtacgtttgcttcaagccttcccaaataaattcatccataggattaaaaaacactatccaaaagaattataccagaattttgttgatcatcaatacttcgcttaagtgcttgaaatagtagctctatctaatacattataactctgaaattggatctcgactcatactcaaaataagcattggagggctataacaagttcaagttttttcacatgttccaacattaggatactttagggcatgcgttgacattgcagttcactaaacatggattatatcacataggtgttgaaaaaattgacccaacctgaaaacctgaaccagcctgactttatctgggccaggtttcgttcagggatctttcagtttggttcttgtatgggtcaaaatttttgacccaaactttaaacagaccgggtagagttcagagctttgacccagattgggtcatgaggggttgaaagtttttattgacatcagggtagtttaggtcgggttcagtcctgatgttatgctaagagttacatggttagtcttctttgatactaatttttgaaaccatctttgaaacaaatcagtaagaatttcaaggattgcaccagacatgttacattgagtccattatggagtgagccttgcaaaatatattagtttctgagtcaaacaggttagactgggtgatgtgtattgacctcggcaggtatggatcaagggatcttgacccaatgtcacaattcaaggttatgcaagttgttttaacttcacctagcctgacttgttgcaaccctaacatcaccatggagcaattgatgcagttcagtgacaattatatgaatacatccttacatagtgacagatacattgacaagatatagatggttcatgtcaaatttttgattgatttgttgtcatcaagtgtctgcatctagctagcatctgttgtattttcataacagagttaatcatttttccagatggacaaaagagagcgatgattatatcacctgaaagaattccatcaattactttgaatgtaaactcattgctgacatcaagtggctcttggcaatcagcagatggccacagagaaggataaccgacacccctgccaggaaaagatgtcagctccttgaagattcttattgtggattattgttcagtgaaacaagaatgttgttttcactccagctactccagagaaatcaatgacatcggagttgggtaaagttattaagagacctatgccatgtcatgctaacccaacaccaccatggtatatgccatgccatttccatggtatagtgttgtttgaacaaatatcaacaccttattctggctattaagactatttcagtaaccaatagtacagtgttgtatgaacaatatatcaacagcatgagcagaatgcaataagctaacccacatagtccagacaagatttgatggatagagtcatggttttgtcaacaccgtccaccaccacaaaggtttcaggtcctggtatttagttttactgttgtaaacctcccagaatttaacggaaggatataaatcggaggtacgttgccattcttcccatttatcccttacattgcacacaacagaaatattaactggctggggacaatagtgaagcaacaagaatgcatatgctgctgaaagattctgcgcatcatcaactagtctcatagtatcaatatgtaaatgggagtgaggatgatctgatgcttcagtctatactttctgagacaaaataagatgcaatttcattatttaaatttttacttttgcttttttatgtctccagcttctcctacttatgaagatgtaaaggacacatttgcgatgatgatagatgattcatgttctagtcactgcttatttgtgatatcgaacattttccagggacttggtccattttatgccatgaactttccaagatattgtcaacccatgctcaatatattcttcaccaagttgattgtatagcatgccctttacatgctacatatattctccaaatattatgttagcctcatgtacaaacagaaaaggaatcttgcagtatttccttagaaacacaacatcaatctactcatgccagagtcaaacttcaaatcctgctactcatgcctgcagttaggtgtagcttacagaacacaacacacaattttctagtccaggtattaacagtgacactcgaccaaaagttttctacatattgcctactgaaaacaacattttctgattcttttttcttttatctatatgcagagattttcttttttatagtcgatctcaccattattgcacaatggacttcggaatttttattttttaatctcagctatataaccacttgactataatagagggtctgttactgcttattgatgtttacattagcatgatcttcttaatgagcaaagatgactaaaatttggggttcctttacctttaatcaaatatggttttcttccattctgatgtatcttttgagcttaaataggttagcaacacaatttatcattatacaagttcaagtctttttagttgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacaaatgattcaaaaaatcttagctgattttcttcttgttttaactttatgaccaatgctttcaggcagtgcaaacaatacagttttgttttcatagctggtgtacagttgagatgtgaccagcctaagggaggtttgatctaggaaaatgctttcacaatcaactttatcaactgaaaagaaagatatttaggaagacctattgcctgaagcacaattatgcttttaaacattctgatttctgatcgtttatggattggatggttaagcaacagggagaacagatgagcgacagatattctgctatgatagaagaaattgtctaatggtagttgtctgcaaaataagtgcttgagatggtgtgccaggaacaatatcttagccgtggcccttgcaaatatggcccatcatcttgcagatctaggcacaaaggaaggttatgctgacagcaggcccaagatgagaaccggtcatctttcccaataattacaccaaatcaagttagctatcaaacatgacccaaataactacagaaataaagacttactggacaatctcttgagcatcagccatggtatatctctctgtataagagtatgccccattccagagtcttggatatgaaggtatctctagtggaaaagattgcttatccacaatatgccaatgaagaacattctgcaagaaagtaataatgatacaaagttattttgagaaagcataatgcagaggtcctgaatcagggatatttgcataagatttcttttttcaaaaaaaaaagggccaaaccaccatgtacatgattttgaacaaaatttgatggtttaatttgaaatacaggtactaatgagcaagagaaacagcagacattcatggaagtagcttgagcaaaataaaccttatgcaggtactagcgagcaagagtaacagcagacatttacagaagtagcttgaccaaaataaaccttatgtcatacccgcagttatcacacttaccaatttactgtaggacattgaatcaataacattctttatcactggtacaggcagataatgccgtgatgtatctgcatcacacggagtaaaaggaaacagttagaaagcatttgcatgtataaagacgatcatgaatttgtgcatgaaatgcagtgtttgccatgccaccctgaaccacctattttgaggcatacaatgccatggtatgaaaacactagttgggtctgcacgggccccataccaaagtgtactgaggtgaatcagggtgcatgctgacccataccacctcatttcaaggagtattatgataaaaagtgataaaaatggctctaaagctatgttggtatatggtgcatactgtattgcactaatctgtaccgcaccgaaccaataatatggtactcggtaccaagattgtggaccctgcacaaaagtgtcctatttttgtatatttttggaaagatgaaagcaaacaacatcattttgctcacataaaaatggtggagaaattttcattctattaaaggtgaaaacattaaaagtagatatttgggataaatgtcaaaagaaaaaagtatatttattattaatgaaaagtgaaaatgcaaatgaattgtcaaatagtaggtaagagaagtagcatgtgcatataacatgatgtgcagacaaatatacacagttgagatggagtcccaccataggatttgaacttggataccatccatgtaagataagttatttagatcgagaatttatatccttgattatgatttataatgtttaaaatgtttaaaatcataatcaaatagtttgaaagcttttaggtatgtttctactgattataaaatggatgatttttaagggcaagatataatatttagttttaaaagggtccaagctcactgtcttctaaattctatatctgatcaatcaattgcatcccaaataatcaaattatacgattcaatgggcatttattttgttctccctcagctgtcctcataaattttacaaattattgttcagcaactgcaaaaacttgtttttaagcatctagacgtattgcaagatgcagattgagatcaatggggtggattctcatttttaatggtgcatcacataatggagattgacataaatttaggctcaaatcctttctgtaagattataggtttatctttctaatttaggctcaaatcctttctgtacgatcataggtttatctttctatcatcgaaagatgctgtaatcgagaaaacaatacagatgtaactaaattgcatgacatctagcatctaccccatataattcatcggggctcattcatgatatgaatgttattgcttttataataactatttcaaatattatctctacagtgtcactacaaacacatcatgctcatctaccaggagtcagccagagaaaattttgaagaatcttttgatggatagcatatttatggtttatcttctcacattcaattcattatgttcttgtttccactattgaaaaaatatatgcactctcaatatccataggaggcctttggtatgaaagacatattaactaagcatatgttcaccttaggaaacttttactaaggaatatgacattaataggcacataagcattaaaagtagccatacagatcatgaagcaagtttaatgacacatgggtatggttttgatattcgaagctatgatttcataatgtagctattttcttgtgcaacagaagtttataaacatcctaaaatcgtgaaattaaaattctattttgaatagaatcttctaaattcattttctccctccttatcatcttgcatcttttcccattttcaactcttatccttttcagaaccaagcacttctagaagtttgcggctctcaaaaattcaaacattttaaaactagaagagtttgcaattttgatttataatcttccacatacagccctagaatttattcataaaattggtacatctggctagtcaatttctaaaacatgcagaaaatgaattgagctttaaaagtattatttagaaaaggagaaggtcaaagccacatttcgttaatagtgaaacattttgttcaatggtgaaacacatttcatcttacttgtatgatatccggatcctattggtggcagaacttcttggacatgtcatagtattggtgtacaaagtcagaatggacgtttgatattagccatcaaaatcaattgcattcatgttagaattgcatccaaggaatgaaagacagaatgcttattcttgactcaaggaagcaaacacaaactccattatataaaccatcaatttaaacttttttgaggaattatgcaagcattatccaagagaattgtatgagccagcataatttccagaatagctgcagcaagcttgccatggattggtccaactgtagaagcacttggatacacttggaagcctgtgaatatatcttggttggatgccttggtccatacaacagtagttaactttcagatgcacagtctgcatctgagatcacagatgaatgcagatcaagttgatggctaacaatttccatgttaaaatacaggtttttgtgacagcaaaagcttggtgtggctctgatagtatatgcagaaatagttatgcctctcattcctagacttcaacaaggtcaaccaggaggtcaattatttttgggcttctgtgaatgattcaggctcactcatgtatctccttgatgacttgcaaatcatgataatgactctaaaagcaattgagtctgatatcatgcacatatcagcactaaagccatcttcagattaaaatgacaaagaggatggagcaggcaaggtggtgagacacagcattataggtcccactggttaggtaaaatcccgacattgagacatttcaagcatcatagaatacagaacgagaatagttacatcattttttagtgtgcacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgcaagtagagttcatccggactcctacgggagccggacttcgtctccgactccggctctaggaagacttcaaccggactcctacgggagccggacttcgtcctcgacttcggctgcaggaagacttcatccggactcctacgggagccggacttcgtccccgactccggctgcagaaagacttcatccggactcctacgggagtcggacttcgtccccgacttcggctgcaggaagacttcgtccgaactcctacgggagctagacttcgtcctcgactccgactgcaggaagacttcatccagactcctacgggagccggacttccacccagaactcctgttgcaggtagacctcatccgaactcctacaaaggccgaactccgaacttctaccgcaagcgatctaccccgagcttctgctacaagcggtctacttcatatttctactacgagcggtccgtgccggattttcgctgtaagccttcacccgagctcctctcagatggatagctacctctttccgccagacgcttcgaccgagcttcggccgacaggccacagtaatggccacgactctgctccacctcctgcgacggattctgcacggctccaccactccccgcaacaggctccgcacggcagaccgcagtaatagccacgattctgctccacttcctgcgacggattctgcgcggcttcatcactctctggcaagtcacgacaacagacgccgctccactctccacaacaggctccacgtggcgggtcacggtgatagccacgaccccacccatttactcttcataacaaactccttcaggccccgagcggcccactgccagacggttacagacgtcgctatcagtctgttgcactctccacctataaaaggggaccccagatacgttattttctaagctcgcatttttatctcaaaactctgctaaaatttcgttcgagtactccattcttgttgaggcagagaactgatttaagcgtcggagggtcttgccggagcacccccaactccggtttagactttctttgcaggtcctggcggtgaccgcgactccagcttctccgacgcaggcggatttttgcaccaacagttgcaaaagcaaaagaaaatattgaaggaaaaaaagaagaagaaaaaaaatgttagatcgaccttgtttcttggaaaaataaatgtagatagatcattaagagctaaaatagaaggtataggaaaagaaaaaatatagtggcaaatattgagggaaaagaacagaagggaagcacggagagagagagaaagagagagagagagctcttcacaggtcaaggacctaaccagtcaaaacagaacaatatcaacaatctatacgggagtgttgctaggtaggtcatctacatgaaactctgttagtaattgaaccacctacctaggtaggtcagagcatcagctaagataatacctcagatcagtgatccatttttagaataaactacaaacaagacactaaaatacctagcaattatgtcatcacagagcacaagtgtgagacaaattggtgtgctgacattgtcacttaccccacaattgcccttcctagtagcaatatgcaatggtctgttccccttgttatcttccgaatgaattattgacttatcaggcttcaccagttcttgcactatttcgacattttggcctttcacagccatgtgaattgctgtctgccccttcttgtctgttcttaaaccaatgctggggtccttatttaaaagggattttaccacttctacatgacccatccttgcagctgaatgcagaacagtttttccattatttcgtgcaatcttagcaagactagcatctgtttctagcagaagattgacaacatccagatggccttgagtggaggcagtgtctaaggctgtagaattcaatgaatttgtagtcatcgccagtgcgggaaaagaatgcaacagctctttcaaaacttctgcaaaaatcaagcaaaccaaaaggagaatcagtcgtaagagcacaaccaacataatacagtacagaatcataaacaatcataaagtcagacagactaaaatctaaaaatttacatctaaacatttagggagcatgaacagatattttctttttcaaaagaatcagatggaaccatggaaaaaaaacttccagagtttgagacacagacatattgttcttgggaagtggaaatctattaagtaacaagatattaaattaagccacacatcaaatagtgcagaatacaacgagaaatagatccactaaaaattttggtttgtgttcacattttgttaatagaaaatggaacaaagaaatgactcttgataactatattcaggatatgagagaggtaatccatgcttcaagctggtaatcctcaccaattcctttttttcattccatacatgataaagtaaataatgcatcagtatgctgcccaaaaatttgaaatcttccatctttattggagtttgtatgtacattgtacataacatgctaatcagttccatcaatacaaactatagcacagtataatatcttacttacaggttctcggtcatccttaaccatatgtatctagctttatgtttcacttagataaaatatcagctgtaaaactactaggagtattctctggccatcagagcagtggctgccatccccaggatcttcaagagatcgtttcagatgtattatcagaaatttctacatttattttttacaacttcacaaatgttgaattgcatgtttaggaaatcctcctccaacatccagtattgacaaactacttccaccacctagcaatcatgctatgtgttggtttttgcttaaaagttatcaggactgctctcaaacacagaattcattttgtattcccttgtggtactgaaacaactgcactagtcaatggtgatcaaaatcacatttatagctaatgcacagcagattttgaggcaatagaattttcttctagaaatcttttttactttgctgctctagctttcaaatcatcctgtattcattcttttaaaataagtgaattgtagatcactccctctaggaacttaatcagatacttgaattaattcatgtttggatatttgctacaccatctactccaacaagtgtgcccattttgtgccaaatctctttgacctttttaaggcgttcaattaagtgtctagtctattgagcttcactcatactattttccattaaaaacctcaaacagattaaatcaagccaataaaatctccttcatgtttccccaatcagctttattcctttcatttttgaggattttgtttgaatagaaccttgctaggcctttttttttttttttcacttctattattttaagcattttggttgtctcatctttctcacccttacagttgtagtcaaggattaaagtcctagtattagcaccaactcagattggttcttggttggcatgctatcaagacaaaccgagatggaactgttgaccattaacaacaaaaataaagagaaaaaaattaaaaaataatggcatccaaagatgccaagcatcccaagtgtcaggacacagccattatagtccatcctggatggtgctaaccagaacagtaaggacctctcaatcccggtgtccatgtgcatcctaggtaccatccaaatgttgaaatgacaccgaaatggcaggatgtgccaggacccaactctttatttatagcagttaattaagttctttaatcaaattccaaacatgatctccaattgttacatttggacagatcaaggtccacccttgatccatcaattggattttttgaacttcatgtccacattccaagtagtggcatttaatctttaataagtcaattcgcttctcttgatggcttgccttcttttgatcaactttgtccagttctgggaattttagggaacccccatctatttcaaaggatccacatcttttagttacctagtaggctttgcctacttcactttgagttaatcacaccttctgctacaatcctaggttagtgctctctctattccccctcccctctccctctgtcctcttctctcagagtgtttagttcagtctaggcttccattgttaactgcggtgtaacatttcttccattttgggtgtttaagtcatttcacatttctgtttttcatccttaaaaattatttttcaccttacttttagctggatacaaaggttaccctttcgacttgctcattccagtaaaatcttttcattcagtcacttcacatcatcttagacctcagaatttgtgaccttcaacaaccgttgctttgcttcaaacaacttctgacacaagcattaccacttgtttccccagcagacccaccctgagcagtcaaaccattcattaacacaatcccggaagcttctgaaccagctagttatacttcatgcacataaatctctcgacttagccatttcatacctgttttagtgtcttcagattctccttatgatattgtcatctgaggcatgttggctgctcataagtcatatctgatcagccttatttgtttgcactctagcatcaaattgtaaaacctagaaattacatgccactcctcaccatccagtttgcttaactgcaagttgaccttgctagccaagttgcctcggtagccagtgacatgaataacagaaagaatagttccccatttattttgttaagatttaaagagtctacaaagcaagagcaggttatgattgttgtttgaacaagtttattgcctaaagttgttccctttctaggagcatattaatctacttcctcaatatgatcatcagctcaccagcatagagtcacttaattgtctgctttgcaaactagagcttcttttaaatgtcccatcacttctgtagtttcccttggaacctttcatcttgttcctgatgttgccttgccacaatttttacacaagtttgtgcctttcatcctcaagaagcatattagttcatcattctagactgaccacctctcacatagatattccttcctattttgtgccagtaccttttatacattctcatttttcactagcaaatctttaatctctgtcgctctctctgtattttataccatgatatggcagtgcatttacatagaacttgctctcactatttcgccaaaaataagatatgatgtcgttcctccactatcaaaaaaggaaaaaaaaagtctcacacattctagttaactcagtgagaattttcaacaaatcaacaagatactgtaaaatatcacaatgtattcatgaaaggatccatagaaagtaagtatgcagaaacagcacaaaattaagcagcaaagaaactgcttattgtcaaggtaatcatttaaaacaaaacatacattgactgtcaaatataaaaagtcaggccatattatccaagatcatcttacaagaccaaaagagatggtgaattcaatcatttttaaatcacagcaccaataaccatgacaagttctagattttataatattggccatgaattatcatttgttttgacactatgtattaaaacaaatacagaaaggagcaaatgtaattgatctgtgagatcaatagcttacccagatggccctgcttagcagcaatatgaaatgcatcaaagctgttactggccttagtgttagctgactgaaagtctgaaaccttcaatatctcccgaacaacctcaacatgacccttctctgcagcaacatacaacgctgtttccccatcttgattctgcttagaaatcaattctttcaattggctctcaccgcaatcagaaagaatcccctgaacatgcactgcattgccagctctagcagccagatgcaatagtgtatcccctcgcttcccagggctttccttgttcctcctctccttgaagctctgctgtttatccatggaccccaaccgaaagctcttttgtttctccaacgatcccatccgaaagctcttttgtttctccatagctcccagacgaaagctctgcaatttctcgaacgctccaagacgaaggctttgctgtttctccatctccacagttaaatagttcttggatcaaagaatttccttttccttccctcttctattctataactttctaattaataacttcactcatgccaagcatctcacccagaaactgtggccaggaaatctcagtttttgactgtgagacaagttttcccccaaagtcatcactgattgggtggtcctagatcccatatacttgttaaggacgagaaccataaaaagctgcctgggtctcaagaaccgagattttcaactatatatatagagaagacaaagaaaagaaattgatgtgaaccttcttttaaaaatatgcctttcagaaatacttcccttcttccttcttcgaaagcaaaactgaactcacaatctcaagaaacccaaacacaagaaggcaccaaaaaagacaaagatttcgaagaacagtcagaagcaaaagccctcttcttcgtccacaaaaccctccttaatatcagcaaaacaaccagctgcaagaacctagaaatccaaaacatccactaatctaatcacagtgatcgaggatcgacaaaaagagttacctcgatgtctgaaatccagaaatccccaacacataccggtgctcaaaatcccaccttttccagatctccaccacacaagcagagccccctttctctccgaacccagaaaaccttaaaaacggaagggcgacgagggctcaactcctggtgggcaacctgatacacctttttctttctctttttctttctccatctaccttactgattccagaagctttgagtacaactgaaaaaacacggtattctttaccccccccacaaaagagaaaacacggtattccggttggtacagcgcttgcgatccacgagaaaaacgattccttatctccagtggcaattaccatcctcccactctaaaagccactcgcgcctacctcccggtttttgcccctggtctcgtgggatgcgtccaagagtgggcggctcaaaaagcgtggtggtggtggcggtcgtggtggggcagcgagagggtaaagtggggacagcgcagacaaaagagtccaaagaaagcagtgggcaaagattccaagacacacgaacgtggcccatcccaagtgcgaagaacaaaaaatctatagctcgtacagtgctatccacatgatgacacgtcagcctcgctatgcgcggttcctccacgggacttggcacaagacctccctggttctctcactcgtcattggtggcgctggctcttgtggggatactcgaaatgtgagggccggctcgcggtggatataattctttttccgattcagataggtgatcacacaactcaaatacggatatgacccataaattaaaaaataaaagatctcgcattattcgtggacacctcccattctatagctagatgtaattcctaatgtgcccgataacgtaagaagcggcccaatccaaacagacacgacgatggactcacgacgatagaagatctcatctatcttctaaattattagatattttattttctattagctacaaatgtatttgtttttaatcagtttcataaagttaaaattataaatatgttttataaatttttaacatattatatttaatctctttatcccattatgagtcaagttattgcaacaatcctatatgtttcaaagaacttatgacattaaaaaatagaagaagatttaaggacaaattataagtgcataagtgcaacaaaagatctcaacttgtcagatattaaacttggtacttcaatgtcttattggatctctttctaattctaaaactaaaaatacttaaaaaattaaaaaatataaactttgaaatggaacttaataaaagtctccgttaggccgagggatgctcatgggcatacaagtcaaagagcctaacttcaaaatgaaaaagtgcattctttcacatttatattataactagtttttaaaccccatgttgtgcatggatttgtatatcatatttatataattaattatatttataaaaaaattaataatatattcatttatatttttaatatttatgaatattttaataatatcaattaataaatataaataaattttaatatttttataaaaaaaaattatgaataatatgtccatccatattcttgatattcataattgaaaatcttaataacatcagttaataaatataaataatttttaattttatttattaaaaataaaatatgtacattcaatattttgaaatagaagagtccaagtagtatgtatagaaaaaaaatagactgcttatgtaaatagctttagttacaaatcaattgttttttattttttaatatatatatattatattagatagtaaagtaatacgtggtattaaagtgttcttctgtgcagacaggttggattataaggtaacctcctgtaataccacgggtttaggtttgatttatttatttatttatttatttctccgcagtgtcctcaccagtcgcttcattcgatgcggagtcgggagccctctgatcagatccgatctcttctccgttggccagagcagacgtggggcaagcggaccccgttaagccgctcgccgtaggggctgaaacccaactcgacagccaggccccccgctgccaccgcctccttcggcggaactggcggcagcatcaccttctttttgccgccgccgggcccgccgctgctccgccttcttccccgtgccgctccggtacttgagccggacccgggccagccagttctcgaaggtggggtcagaggtggcggatgccggaggttccgcggggggctgccgaggaggaggaggaatcttggtcggggttgggatcgtcggcgagcgcgtgaggggcgagggggaggggttttcttcttctggtggtaagtggggagggattgagggtggaagagagcgatggatgggggatttggaaggatttggggacgacgccggccatcctcttctattctctttgtgttactgttaggtcttcttcccctggttaaattaatattctttttgtgtcagcttctccgagtccgatagattttcagaagtggctggaacgactggcttctattctcttctaattatttcataacttttccagttagcccgaggcttttttttttttattttgattttaaatagcctacaaatatatgaaagagagaaagagggcttggatattatctaaaaaatattagccctttttcttttcaatatctgccgccggctgatggtcagcgatcaggaccccctcgatgccttctgccaggagagcggtcgggacccatttcttgaactacgatttatttagaaggaacgtcatctactacatctattacgttctaaaaataaattattggataaatatgttacatgaacaatttagatgatctatgatattaatttatcaattaaattttatatttttgagtctatgaataattaatttttatcatcattatgctagaatctatataaattatctaactaatttatattgattagattaaatatcatattgattaaatttttagataaaatgatcaataaatattatttattttgatctaaattattattttaatttatttttttattttaattaaattataaattaaattattatatttatatttatattttattttatgttgaaatttattattgtgataattatttttttatatttataaaatcaacgagtccgacgtcctcccgctgctgtactagtgaaaaagttatataacgtgcggaataaaaaataaaaaaaataaaagaatccatcattttcagcattaagagacgaccacctgttgccaaaagagagagaaagaactttaatccacggaagatgtgacatttggcatgataaagaaaataaaaagatagatatcaatcttgatggctcactggggatccagatctggagcctgatgccgaggatgtacttgtcgatgtcgatctcctcggacattgccatctccaaggcataaacgtcccttgcatccgcaattcccgcttcttatccttttgcttcaatggcagctctgattccaaaccacaaatccattgcattgatcgaagttctttatctaaataatattaaaaaaattataaaattaatacatcttctaatttatttataaaaataatatgaaattataaaatattatttcaaataatattttttgataaaaaatatcatttaaaatgatgtttctctgctccacgtcatctcttccctccctctctcatagaatcaaaaataaaaataaaaaatcatcatttgtaatgacatttttgaaagtgccatttcaaatgatgtttgaaaataatatttaaaataatatttttaaaaatctcaagtgatttaagcctcttctttccttctgtttttcgttctccgctcgttcaccatcgatccctgcttcgaccgctccgatcgatctccgacgagctcaccgtgccgataagcccctcttccttcttccctccctcttccccctcttctctccctctgccggcggcggctgccccctaccctccgacccttggccggtggtagccccgccccccctttggcccgacggtggcccccctttggcccggcggcagccccaccccccttttacccggcgttggctgcccccctccccacctgtcccccctttggctcggcgacagccccgccccctccccttagttccaattgatgacgataaagatgtccaaaaaatgctgacattttctttgaaatattcagaatgttgatttttagaattatatattgaaaaggaagatgtatcgagctttgggtactatagtcggcttttaacccaagagggcaatactcctgggccttcctcgcctttcgtaactcttatggtacaaaccaatagtgttgaggccatgtttgcaaaacaacattctactactgctggctcttgttgtccaattattcaaagtcctatggtgacttctcctgtgatgtcttctgctacggtgacttcttctattgtggaagtagtagtaagtacgggatacaacactcatataggggactcatataggggatgatgactgggtggtggtggaaaaattctgataatttaggttttgagtcagatgacagtgaggatgaagattattggatggatgaggacaatagcagtgataatgatgatgaagatggtgatgaagatgttcatcttgatattaatatgggagaacctcaatcttatttgcacgaacctccataattttttaacaacataaatttagatgatggtggttgtgttagcgctggtcgaagattgaactctgactatcagtagaagaaattataggctccggagatgtattttcaatattgttttatgtatttttatggaattatatttttaatattattttatatctagagatgaactatattgtgtgtttaagttgcattatatgataatattgtgctaccagatatttactagtaatgaattagtgacatcatcattttcatatattgaaaattatatttttcatgtattgaaaattatatttttcatgaaatgaatagctatcatatttctcatgctctaatatacttgggatatatatatcattattttaggttcattagcgtgttatggcttacgatctacggcattcaagccctcgagatagaagtattcttatattgcaggagcaccattggtcatagactattttagatggcggtataaacattccaatcctactcttactacttatattttttataaaaaaaatcttgttaaggtcatatacgttatctaatactactcttactacttatatatgtagcaggacatgtcccattagatgtagatgatgctgcttttgaggatctatttggtggcgtacagtatgatcaggctgatccactaggatgcaggtatataactagtagcactgattttacatgataaataactgtatgttttcatataataatatagtggctttattttggacagatggaggactcgattgactggtgctagcaatttggtgtcgcacatagttatatattatagagatcagttagatcagcagcgtgatgatcagatattatggtgccttacacatcagatatattgactgtattgtcagatcagcatgtatggaggatacgcgcacctctcatttgcttcgacatcatggagatttattgtctggagcacgtgatgcgacagtttggcatgcaccaggacgttcccccactatgtgacactcgagatactctctactatttggatcgacgagggggacatcatcatgattgggttcaagagcatcaggagtatattgatgcatgagagcgatgagaggatttgattgttgctggtccacccatgcttcccatgatggattattatgatccatatctgcagtggtacatgaacatcaccagacgattcatctcgccattaatgagtgagtgtttcgagatgaggttccgtgcttcaggtggtatgatggatattgtggtaagtatattttgcttttatctcattttgttatattgttattaatatacttataagtaatatttatttttttacaatttcaaaggattacatcgctatatcatacggtaaggagtagattccattcgatcattgttgaatgtaaggatcgagcacttatcgatattatggacgaccttattgatactatacgagttgtctcagcggatagatgacttcagactatgccatcgataatcaaagatgagatgcatttatgagagacggacacgtaggagccccaatatcttgatatatacaaagatagttatgatatttgtacatgctaaaataattttgtaatcattaatgttacaatttacactatattagttgcacaaaaaaatttaatcattaatgtctaatatttaatcattcaacatcatttaaccattcaacatcattctttcatactaagaagatatattcataccataaatcaaaaaatactataaaaaaatacagtactacatcatcacactacataatatatatacaccatataacatatacaaccaaaaactatgacatcatcgcaccacagaagatataaaatttgataatctaatccttcggatcagcttgaacagtagagtgatagcgacgagcaaatgaagatggcctagaggaggatggctgactaggaggaggctgactaggagaaagctgactagattgatcacttgaaaaatttgaaataagaatattcatctattagtcgatccgagcaatattctgtaaaactgtagccaatccagtagaaagaatattttatctttctattccattcgattctctctgtatcacagatgtaggcacctacatcttgatccctctaggcgcctacatcctggctcacttttgttgggtcacgggtggatcacgagaactttagatcagatcacaggaactttaggtcatgtcatggcatctggatgctaagcaagtcacaggtgccaagcaagtcacgagtacctataacatgcaagcataagtgcacatcagaacggtgctggttggacattagcgagatgcttagagatgagcgactgtcggtccaattaggcatccacttacatcagtgcacatccatgatgatgattggatattctgaagatcatcttcctctctctatagtaggtcgtcctatagtagggcggctctatttgattacatctgatcatcgaaccacgacctctgatcggattcgatcggatctgaccagaggatgaccgaattcgatcagaagatgagagctggaaggatccagatccgatcggaggatgagagctgggaggatcctatcggaggatgaccggattcgatcggaggatgagagctggaaggatctagatccgatcggaggatgagagctgggaggatccgatcggaggatgaccggattcgactggaggatgagagttgggagtatccagattcgatcgaaggatgagagttgggaggatccgatcgaaggatgatcggatccaatcagaggatgagagctgggagaattcggatctgatcagaggatgagagctgggaggatccgatcggaggacgaccgaaggataagagttgggaggatttagatccgatcgaaagatgaaagctggaaggatccgatcagaggatgatcggatccgatcggaggatgagaattgggaggatccagatccgaccagaggatgagagctgagaggatccgattggaggacgatcgaatctgatcgaaagatgagaggtgggaggatcctcataaaattgccatgtagtagggggctttatgagtcaccttttgatatggtgactcctagagtcgtcatttctggctgattcaacactcccacatggcatgagggcgggttaggtggcacttgatagggcgactttctttcgaacagcatcttcgtaaatattttttgaagaatattattttcataaattattttaaaattaataataaattagtaaaaaatttgatttggactggtataggtcggtacgggacggaacagggatagtatggtttggttttctattttttttgggccattggatggatttttttgaatggaggggggttctaatcaagaaaatgccatttgttatggcgtctttgaaaacaccatttcaaatagtactttcaaaaatgccatttgaaatgacgcttttaaaaatgtcatttgaaatggtgctttcaaaagtgccattacaaatgatgatttttttttttggtcttttgattccacgggagacggggggaggaaatgacgtggagcgaagaaatgctatttcaaatggcattttctatcaaaaaatgtcatttgaaatgatattttatcgttttgcatcatccctgtaaataagttgaaagatgtattagttttgtaaaaaaaaaaattaatattatttaggtaaagaagtccattgattgtcccttgtttacttttggaaataaaaagagatttttggaggcagttataacgagtgaaatctacaggtaaaaaaatccagcaatacgggcgggaaggcttgatattagccgcaaaaagaaatgatgaaagactataattttttagcaaaaaagtgagtaaccctaaataggatatgatctaaatctagaagttagaaagcaagaaactaagtataaaagctagaaaactaaggaaactagatgtaagagctaggcaagatatagtaattaacttctccatcttgctgtcaaaggacttcttgttagataatttatttatttttgcttgaatcgtattctgttattcatgcaaaaatcaaaatcataaataaatcataccttacaccatcgtctcaccaatacgatgatcacatcatccacagaatatctgatcttccttcacaagcaactggtcttctctctcctcaccctccttaacacaaacaatcgatgggaatcatcacaccctcctgagagatggagaaaaggatcaggccacctctatttatacttgcacttgtcttgtcccatcagaagatttaatcctaattaaggttgaacttccagtctaaatcttatcaggaataggattctttaattaattgagctcactgtaattaattcaggacatatggttgatccaaagaattaaatctgacgaagtgatgattaggtcatattaagagtcaaatccaacattctcctacttggcctatattatcacttaaaaataactatttgatttttcaaaaatatattattttaaaaaaatattttaatttttaaaaacaactgtcctgaatcaaaattttgaaattgacctgacgagtgtgcactcatttttaaaatttacccaattatctattccttgaaagatcctttatactttgattaagtaaaaattattaatatagatcatagcggttatacatctcaattgacagtctcttccatgtatcataacatcaataattctcacttaactcagtcttatatattagaatacataagctattaaaaaccataatacctatgataatgatcccactattatgtcatataaatgacacttctgtttactttaatttttgacaaaaatcaagtataatgtatacgaacaataattaaacagaagtaatagcagtcatcaaaccattaagagatcttaaaacaagtacatattacaaattaaatatcctaataacaaatatccataacttttacatgctctttaaaaattttgcacactaaatctttcatcaaaaggtcagttatcatacaagtagtaccaataaaatcaatagatacctgatgactactaattcttttactcatagtaagatacttaacatcaatatgcttatttatattggtcatcttgctactattagagaaagaaactgcagcagaattatcgcaataaattctcaacggcttgaaaatagaatccatgactccgagccttgagataaattttttcaaccatagagtatatgaggaagcctcgtagtaacttatatatttagtttccataatatagcaggcaataatgcactattttgcgctcctccatgaaattactccaccagccaacaggaagatgtaacctgatgtggacttcctactatcgaggcaaccgacataatttatatttgaataactgatcacctccaaccgatcaatcatcttataagtcagcatgtagtctttagtctcttgaagataccgcatcaccttcttggcagcttttcagtggaccatacctagatcactctgatatctactaagtattttcaaagtaaaattgatatcaagatgagtacatacttgagcatacatcagactatgcattgcagatgtataggatatatccttcatctaatttctttcaatctcattctttagatactaaaatttactgaatttatcatccttaataattggcacttcacttgatgagcagcttgacattctaaatctttttaggatcctagtaatataattcttctgagataaacaaaataacctcttattcctatcacgatggatttctataccaaaaacataagaagtatctttcatatcttttatgtcaaaatattcgaaattttttttaattttatacaagagatccaaatcactactggctagtaagatattatccacatatagaactaaaaatataaacttactctccctcatctttagatatatatacattgatcaataatatttttcttaaatttgaaggaagcaatgatataattaaactttaagtatcattacttgaaagctttttatggatttctttaatttacatactagctttttattttcttgcactaaaaatttttcaagctattccatatacacctctttctttaaatctccattcaagaatacagtcttgacatctatttgatgtagctctaaatcaaaataagctactaatatcataatgattctgaatgcttccttttcagaaataaaaaaaaaaattatgataatcaataccttccttttgagtgaatctcattgttataagtctagtcttatattttttgatattatctttgaaatctcatttgatcttaaaaattcatttacaacctacaagcttaaatccttcaagcaattcgacaagttcttaaatttgatttttaatcatggattctatttcatctttcatggcatctaaccaaagcttaaaatcatcactattcaaagtatccttaaatgagattggatcatcttttatctcaatatcataatcacattcttgtaagtaaacaacataatcatctgaaatagtcgatcttctaattctaatagatcatcgtaatatttcagattcagtatcattattatgattatttttaatcggatcaagctcattgatagtctgttcagaaagtgatgtatcaatcacctgttgatgttccataatttcttgttaaatagattcacatggaatatctctaggtgttactataataggaagagatttttttattttttgtaacaccatattatacggttcactacttccactattttcaccatcctcaatgaacctagcagtttcagttttaacaattttagtagtgtgtgatggacaataaaatctaaaattttttgatctttctgaatatcttataaaataataactaatagttttgagatttaattttttttcttgtggattatatagtcgagcctctgcaggacaacctcaaacctgtaaatgccctagacatgattttctaccatccataactcaaaaaaaaaatagaaacgaccttactaagtatccgatttaagatatacatagcgattttcaaggcttctccccatcatactcctcaccatgtccatcaaggtgtgattatgtctttcagccacactattttgttggagattttctgacatagtgtactgtgttacaatgctatgctgttcaaaaaatttggcaaaagatacaggattatggtcagattcatcatacctactatagtattcaccatccctatcagatctcataatcataatttttctatctaattgattttttacttcagctttgtatattttaaagattttcaaagcttcaaatttttcatgcaatagaaaaatataaccacaatgcgagaaatcatcaataaaagtaatgaaatacttttgccactccaaaataagatataaaatagccacaaatatcggtatgtatcaattttaagaatttttgacttctagtggcatgctttttatatcttttaatttatttttttaatacaatcgatgcacataccaaaatcactaaattttagatttgataaagcacatttcttaaccaatctagttatcctttcttttgatatgtgatctaatcgtctatgccataatatttaaaaactttcattcacaataccacgtttcattctaatattgatatttaaaataagtaaagattatttaaaagaagaattcaaattcattttatataatctattgcacaatattcctataacaactaaaataattttttttattaatttaaaacttgaatttataaaagcaaataaaaaacttctaaatcaagtttttataaagaaattaaatttttagatattaaataaatataaaagatatcatatagatctaattggaatccaatatctataataaatctgtaggtcccaactgaaataattttggacttcatccgattctccataaagatccaccactctttattttttggctttcgacttgaaaggaatccctgtattgagttgtaaacatgaatagcagcatccaaatcaatctatcaagtattagaaggaacatcaataaaattaattttgaaacaaataaatgataagagaatatccttcttttcgaactatttctttcttttcttacaatccttcttgatatgtccctccttgttatagaaaaaatattttaatttatgagaatctttctttggtagattgctggaacctttatgctcttttttcaccttctttcttttaggatgctcctgtgaaaccacatgaataattgggaccccttcatgtttcaatcttttttcctcttgcacacactaggagattgagttcattcattgactatgattccttatgtgtattgtaataaattttaaattggataaacttagatggaagagaattgaaaataaattggataaaaaagttttcagatactgtcatacccaaatcattcaatttttcagctatatcatatatttttataatgtgctttcgcactcttgaaaatccgtcatattttatagagattaacttgttcattaagataccagctaagactttacttgatctgataaactattgttctacaaagaaaatatacttagaggccaattcgttatcagaaacagatctcctaatatctctcgctgtgaaactcttaataatcatgaaagataatctattagaatgctctcatttttcacataatttcttatgatcagactaagacttacgaaggaccaaatctaagtctaggcattctaaaacaatgagaagctgctcatgccaatcatgataattcgatccattcaatgtgcgaatgttagataaatgcgatgagagtaaaatgggggtcataactataagtaaaagaatatgctcataattacgatcatgatgcagattttctaacacaattctgctaataacacttattatacaactataaaacatctttgggcaagaatcatagcatataataagaatcataactaatttaattataaatttatatataataaacaatgccaaaacatgcatcacataaattataaccaacaataatatgaaatatgtaagcaagaataataattatggcatgtacatataattcatatttaaactatgatccatcatattagttatatattcagtggtttaactaactacgattacaaaaattctaggttattcccatctttgaatgtagaattctccatctttatgtaattcaagttagctaacctattgctattaattttgtatcaaattacagtaacctttgggtcaactgtaacagatacacctttatgtaattttaaaactataatgagagaaaaaatcatcagccctcaatgactcagttattcaaaatctatagagtgctccgagccctttggggctatgcaaaaatacacttgaatattacaataatgagcaaaattatcaaataaataatatataaattatttaaatattttatcatgtatgagaatagaatcaaatattcttcaagccatcatgagtccaacggttcaaaaaaatgctcaaatcggatataaaacgaataagatacagtaattttaccaaaaagctcaatattagaggattcaatcgtaaatctcagacaaaaaagggacttttctataagataattatttcaaaataagtctgtcagaaaacttcagggatttttctgtaataaactatgtcaggggtttatttgcaaaataattttaaataaagctcagattaacgggtttgggtctgatctgaaaccttaatggatcaaacctaagacccgaaaggctattatgggttcgtatctggatctgttaggacccaaaacccgataacccaaactctcttcttccacccctgatcgtgagaagccctaagggcttcttccacgttgtacgagcggtcgagcgccgcccctatccaccccagccactgaagacaagaagcagggaggggggtggactgccgccctcgtcggagcactgcggaagccctatcgccatggtagaagccatgatttttcatagccacacggagacaccgcgtgcggtggtggctcccactgccgtcggggagcaggagctccccctccgccggcgacccaccgccgtcgttggcatggcagcggccacggtcgctaccccattcgtcggatggcacgggtgggtgtccgcggccatcccaaaacccccctttttttaatatatgtttcaggaaattaaaaaaatattatttaattttttaaatcttattttattttgaaaaatataaaaaaataattttaatattttaaaaataattcataaatttttacatgaatatgaagcatgaaactggggctctgataccacatgttagataatttaattcctttatatctagatcgtactctgatatttatgcaaaaatcaaaatcataagtaaactataccttccgtcgtcatcttgccaatatgatgattacgtagtccacaaagtattcaatctttcttcgctggtggctgatcttctctctcctcatcctcctccttaacacggacgatcgatgataatcattacacccttctgaaagttggagaaaatagatcaggccacctctatttatatctgtacttatcttgttccatgagaagacttaatccaaattagggtgaaactttcgatttaagtcttatcaggagtaggactctttaattaattaggcttactataattgattcatgatatatggctgatccaaagagttaaatctgattaattgataattagatcatattatgaatcaaatccaatatttttatataccaagaaatccaccaattgatgccatgaagtatggcgcaaccatggactccatcaactatggccttatcccccataatctataaaggcttgtgtagaatccatcggacaaggaaaaagaagcaagatagtacacaaaaaataattctcattaacttgtaaaataggggatacataaagagaatccataggctttgagacacctacaagcattacggatgccatagattttaaaaaaaaaatcaaaaattaagttccaagcttctcaaaagattacaaactatgtaattgtcaccgagttggtgattttagaaaaaaagccttttgacaatgtagtaacaattgtcagtattgttaaagatattaatttgtaattctagaacctagtattaattaatagtctttgagaaattcaagagatttgggaattctaaatatcatcttgagaaagtcaagagacacatttatcaggttctagaatattaagagtcattttgtaactcttgagagccacttttgcattcatagtggtcagattcaagagtcattttttgtatctataaataggaggccatagagcccctggtaagatgtgaagcaagagttggagcctttcctatcatatctttcctctctctttcagtagaaagtcatattctttcgcataatctcttgtattctttctagcacccaacaaatttggtattagagccatcttctctcttgcctcatatttgcatactaagccctccaaaatccacaaacaagtcttataagccctatggcagcaagcaccagcaataccaccttcaattatacccaaactttagctcctatctttgaaggagaaaactatgactatggagcatccaaatgaggatgctcttcatatcacaagatctctaggacttggtggaaggagactatgaagaaccagcaagtactccagaagctttcggggcatagaatcaagcaaagcaaaaggagtatagggagtgcaaaaagaagaatgcgaaggccttactcttcatccagcaaggggtaagcaagtccaactttcctagaattatgggtgcaactaaagctaaagatgcatgaaaaatttaaaaaaaggattttcaaggctccgatagaataacttgtatcaagcttcaatctttgtggagggagtttgataatcttgaaatgaagcaaaatgaaattgttacaatatttctttctggagttgcttgtatcatcaatcaaattagaagctatggagatattattccagaatgcaaaattgtctaaaaaattttaagagttgccagctaaatttgagcatgtagttgcagcaattgaagaatcaaaggatttatctcttttctccttgcatgaactaatgggctctcttaaagcacatgaggaaagaatgaacaggttcgcctcttagcttctggagcaagcttttcaagccaagcttacaattgatgcaaagaagagtgagcaagacagcaacaaggagtcttctcaaaggaaagatcaaccaaaaaaaatggaagccaaattttttggaagctcaaggcaaaaagataggcataaacagtaacccaagaaatggtaattccttatcttaatgttttatttgcaagaagtttgggcatgaatcaagaaattatcattttaaatgtacaagatgcaaaattccaaatctttctgagagggattgttagtataaagaataaaaggcaacctaatgaagcaaatttttctaaagaaaattatggtgatcagttgtttttactcttgcatgagtacacaataagaatcacaagatacttgatatctagacattagatgcagcaatcacatgataggaaaccaaaagctctttgtccaactaagccggcttcttctcaaatcaagcttagagatggcaaactataataagttgaaggcagaggtgtggtagcagtttacaccaaaggaggtataaaaaaattaattcatgatgttttatatgtttctggtattgctcaaaatttccttagtattagacaattggtgcaaaatggttatttggtttcttttgagaatggcgaatgcacaattcttgataagaagaaagatattgttattgctaagatcaaaatgacttcaaacaagattttttctcttatcatgtcaactgaccaaaatattgtcttaaaaggagaaaatcttgatgattcttacttatggcatttgagatatgatcagctcaactataaaggcttgaagttgttgaaaaataaaaatatggtaattgggcttccatcaataaacaaagaaagtcacttatgtgaaggttgtgtttatggaaaactgcatcggcttccatttccaagagggcttggaggccacaagctccgctagagctagtgcacgttgatctttatggccttattagaaccccttcttttaatcaaaaaagattttttcttctctttgttgatgattataccaagaagatgtgggtattctttcttgagcaaaagtcagaggcattctctttcttcttccagttcaaagcttttgtagagcggcaaagcaatcatcaaatcaagactctaagaatagatcgtggaggagaattcacctttggaaccttcatgaactactgcaaagagaaaggcatcgagagacaactcactatccgctgcacaccagaataaaatggagttgctaagtgcaagaattacacaattgtagagatggctagatgcatgatgaatgcaaaggcttgccaaataatttttgggttaaagctattaatacagctgtttatatcctaaatagatctccaacaaaagcaatgctgaacaaaactccttatgaagcttggcataggcaaaagcctgaggtaaatcatcttaaagtctttgactgcatagcttattctcttattccatctcaaaatagagataaatttgatcaaaaagaaaaaaagcatatctttattggatatagtgatgagtctaaaggctatcgccttctgaatcctacaaaaaatcaacttattgtttctcgagatgtattctttgatgaacttgtagcataataatgggaggccaatcctcttgaaagtgcaagaagatatgagcttatggagacagaagcaaatcaagagaaaactgagcatcaaccaagcccaatgagagcattaagggaagacatttcaagtcaaatcatcacagattctatttcatcccaaaaaaggtgtgcagcttacatgagatctatgaatcttgtaatgttgccttcttttcatgtgaaccacaggattttaaaaaagcaagaaaagatgagatttggctaaaattcatagatgaagaaataatcactatcgaaagaaattgcacatgggagcttgttgatctctcagaaggcaaagatgttatcaaggtcaaatggatctataagacaaagttcaaaaaaaatgactcaatcgataagcacaaagctcgtctagttgcaaaaggttatactcagcaacctgatatagactttacatggacatttgcatctattgttcgtatagaaatagtgagaatggttcttgctgttgcaattcaaatgaaattgtcggtttaccagcttgatgtaaaatcggcttttctgaatggtgaacttgaagaagaaatttatgtggagcagcctgaaggctatattatacaagaaaaagaaaataagatgtatcggcttcggaaggcattatatggcctaaagcaagctccgcatgcatggaacaccagaattgatggctattttcactaaaattattttcgaaggagccctagcgagacttcattatacataaaattgcaaggtaaggatttcttaatcttttgcttatatgttgatgatttgatctacaccgacatcataatggaagaattcaaaagagcaatgatgaaggaatttgaaatgactgatcttggacttatgcattattttcttggcatccaagttactcagtcgaatgaaaaaatttgcatatcacaatagaagtatattgaagatttgctcaagaagtttcatatgggaaattgcaagccgatggccagtcgtttggctaaaaataagaaatttcaacttcatgatggtgctcaaaaagttgatgccacaacttatagaagtttagttggttcactcatttatgtcacacatacaaagctggatattattttttcgattagtctcttatccagatttatgattcaaccaagcaaacttcattatgcggctacaaaaaggattcttcgttatctacaaggcactaaaagtttgtgcctaaagtatgaaaaagaggaggataacaggttgattagatattttgacagtgattaggctggttcttttgatgatcgcaaaagtacattaggctacatattttgcctaggaacaaaagcaatatcttgatctttcaagaagcaaatggtagtggcactttcatctactgaagtagaatatatttcagctactgatgtagcttgtaaggctgtatggcttaagaggaacttttcagatatttttcatgaagaaaaaagttcgacaattattcggtgtgacaatatgtctgcaatagctatgataaagaatcttgtgtttcataacaggaccaagcatatcgagattcactttcatttcatcagagacttgttgagaaaagagatattcaactagtgtttgtcagcaccaacaagtaacttgcagatgtcttcatcaaggcaatcatgattgaaaagtttcagcaagccagagatactttgggaattacaaattaagagggggtgttaaagatattaatttgtaattctagaatctagtattaattaatagtcttaagaaattcaagaaacttgggaattccaaatgtcatcttaggaaagccaagagacacatttatcaggttctagaacattaagagtcatattgtaactctgagagccatttttgcattcatggtggttagattctagagtcatcttttgtaactataaataggaggcaatagagcccctggtatgatgtgaagcatgagttggggcctttcctatgatatcttccctctatctttcaatagaaagtcatattcttttgcataaatctcttgtattctttctggcacccaacaagtatgtgatgatggttattctaatatcgaaatattctgatggtcacttgttgcactgttggatgctttgccttaggactctaccttggacctagtttaagctacttttgatgtttggttcgagcctgatggcttgcaggaattcaaccctgataaataagaggcttggtgttcctcactggagtctggttcagactttgaaatattctaccatacaccatgatcgattttttttttaaatattattttttaatatttattttcaaatctacccctcttttcatcttatttccaaaaatacaatacttgggctgagtttgcacggatacggtgaaaccacatattgaacatgcgattttgaatataaaactatatgttcaataggcaatttcaagtgacatgacctaccataacaaaaaatttaaaatttaaatttaatttcatttttcaacttgaagtttcaatttttattccaaatgaaatcgcatcttcaagatgcggtttcattccttttttttttggttcctacgggtgcatctcttctttttcatccccgacttcgtaccaaaggacaagcgggggtgggggcttcactgggatcatggagggaaggaggggggcatgcactgggcggctggggcggtggctggatggtgggggtggtgaggtggggtgcgacgcagagagggatactgtcgagtgcgggcgcaggggtcaggagagggcggagtgggttagggggtagttttgtgttcgcggggagcaacaaggggcgtgggtgcaagcttcgtcaggactgggggtttgggggcatcgggcagtgggggctgtagggtgcgggcacaagggtcgagggggggtatggcatgggggagccataggaggtgtgggggatcacggacgaacaataggtgggggggcagcggcaggtgcagcatcgacgacggcggcctgggcctcatggagggagagggaggcggccatggcgatggggagaaatgaacatggggctcgaaaggatggtgcagagaagcgacggctggacggaagtgccgtgggtggcacaccgaagggggagtgggtgcgggtcaaccatcggcaaacgaaggtgaaggatcgatgggggggatgtgggaggaagggaaggaagaaacgaaacgtgtgtatgtatgtatgtatgtatgtatatataataataataataataataataataataataataataaaatatatattatttgattaataataaaatatcattattattagaaataaaaatagaaggtattaataatattattttattataaaaatttatgttgaggatatttttgaaatttagaaatagaaggtatttatgtaatatgatattaatatattaaaattaataaaaatgatatattaataatatattaataaaataaaatttatattgatgaaataatctattaatgcattaataatatgatattttattaaaaattaataaatatatttatcactaaaataaaaattttatataataataaatttgctatctgcgcccattgccgctctgtgcgaacacaaaaccaaccccctaccccacccgctttgccctcctccggcccgtgcccatgccctcttgcatcgcaccccaccaccccttaccgcttggcccccctaccttggtcttggagaagcccacacctgcagctcctgcttgccctttggtatgaagctgggaatgaaagaaaagagatgcaggaacaaaaaaaagaatgaaatcgcatcttgaacatgcaatttcagtaaaatcgcatgttcaacatgcgatttaaattttaaatttaaaaataaatttaaattttaaatctttgattgtaatgggcacgtcaaataataatatttttattaatcaaataataatattttattattaatatattattaatatattatttttattatttttaatacattaatatcatattacataaataccttctatttctaaattacaaaaaaagatcctcaacataaatttttataataaaataatattattataccttctatttctatttctaataataatgatattttattattaatcaaataatactttattattaagtaaataataatattttattattaatcaaataataatattttattattattattattattattattattattattattattattatatattttttgtttctccctttccttcctcccactccctcccacccctccgctggtcctccaccttcatctgtcggcggtcaacccgcacccacccccctctagcacaccatctgtgactcctccgcctggccattgctcctctgcattgtccttttgggctccacatctatttctctttgctgccatggccgtctctctctcccctcgcaagatccaaactgctgccgtcggtgccgcacccaccacggccccccccactcattgttcgtctatggcccccttgcccctacgattccctcgcaccgcaacccccactcaacccctgcgcctgcaccttacagcccccggcacccccatcccctctaccccctccaaccctggcgaagtccgcacccccctcccccgctctgcgcgaatgcaaatccccccaatcccctccgctctcctccggccctgcacccgcacccccgaccccgtgctgcactctactgcccctgtagcccagcacccccttcccttcttggtcccgacgaagcccccatccctgcttgtcctttagtgcgaagtcagagatgaaaagcaaaaaaaaaaaaaaaaaaaaaaaaaaaaaagaagatgcactcctagaaatgaaaagaaaaaaaaatattttgaataaaaattaaaactgtatattcaatatatggttttagttttaaatttaaaataaattttaaattttaaattttttgttatggtagatcatgttttttgaaattgcatgttaaatttgaaatcacatattaaaccacaatacgtggtttcgtcgtgtccctatcaactcactccaagtagcgtatttttgaaaaaaaaatagaaagagagcagatttgaaaataaatattaaaaaaataatatttttagaaaaaatccctccgtgacctctaatgctcacataaggccttctacttcctgtcagcatgatctcatcatcaaggatggccttgacttcttacccttttttttttttgggcgtcatcagtgctggaacggtgttacgtctttgtgaggcggcaattgtatgtggacttccatgggcatgtttgttttttttttttgatgcaagacttctacggtcttgtttggctgtatatgtagcacattatgacttgtgagaggcgcggagcgagggtaagaagttctgtcacggtagagccttgatggtgacgtgctcgtaaaccagcaccttacttttattaattatatcaaatggacttcatataaaaattttgcttaattattgatttttcaagcaaatatcatttttttgtaaaaataatagacatttaagggacatcaagtgattctattctttgatttaagctaagctaaatattggatatttggaatatgtataatgattgttcaatggatatgtattagatttcttagacttcgtagcaaaatagtccatgaatattagccattatacttcatccaaaaaaaaaaagaacagccgttatacaatatttgaatatcatataatgattgctcaatttttgatcttctcctaattattttgatgcatcaagtgtatgtgtccccttgtctaacttacgtgtccttatatatacatatatctactaacatcactcaagttaccgaatggcttcttatttattagataaatgccttgttccaataattttgtccatttatcattgatgtagagatatagagaatggacaataattatatattatagctaactttatattggtcaaaatatcacgatatttatgctcgttgtttgcttgcaagactttttctcttttcccatctgccaccgagacgcatctcttgcaacggagaaataatgattaggcaaagggcgagctagaatggtcaaaaggattacaaagactccattttctcgcaccaaattggttatccaagagaggtgtttaatccccatatttagcccctatcacttacaggtggcagtttcagggcctcccctgcatcctatcttttatgtacaggcttaaatggaaaggtccttaattatttatgtaaaaaagagaaaaataagaaaaagggtcattatctttcataaattgaacccaaattttgtatcagcaaggcttcacaaatgtgtcgtccacatgttacaatccggacttaatcatagcggtagttattattaaattgtgattcaaagactaacagcagctgttgcagcatcactattccattttgacaaaaaaaaaaaaaactcaatcaaagattcgggtggccaaagtagggccattatcttaggtacaactgagaatgatggttttggaggggttgaaacctactgctctttagcatataattaatcgccaacctaccttcaagagaaaacataatggctaacttcagatccctagcacaagctacggttagtacaatattatctgccgccactttgtaggatttctagttggattaactggtcaataaaatcaaacaaaatggaattgtgggaacgagatgttattaaaaattagaaacattcataatgatcagataagtttccatgctttgctgcccatggcttgctaaaaccagggaggttgagcttgggatggtagcttcacagtttcaaagttaatacatcacacgctttacaaaaagaaaaatttttgtggctgataaataatcctagcttttttttttttttaattaccgcgccaacggaagctccatacttccacgcattctgttcccctgttttgggggtgtgggttccctctccatcaccatcaaaaacaaatttccactacatttctgcatgaaaagatccaagcatttacagagaccaacccgttgggagatggtctgcagcatgagtaagaactagagagaagtctgtatttctgtgttgttctcttcacccttctattatctctggacttttctgttattctgccacgaattgcaaggcatagtaacagaagtatattttcaaagcttcactatgtttattgagacttggcatgcactacaagtattgtacaagtgacttggactatatataggtccaagtttttttttttgctctttcataggtgaaatagatcaagttcacaatgtatttatcctatccggtaattctaaggttttgcacatcaaataaccataccgtgctactgaatcttaatttcgataattttataactcaaatgatcataaacaacttggtggcacaacaaaaccagagacagtgccatcagcatgactacaaaatgattttgcttgttggtccccataggtgagcttgatgtcttgcagttcaattccattacatggattgcttgcactgcagtcaaagttcatagccacttgtgatgcagatgatccttggatatcactgtatgtcacttgacttatcttcacgccagaattctattcaaaacaaaagaaaatgaaagcttgaaaattcatagtaaaacaaacttctaattttaattgaaaaattatttttacaagttcctgcacctagctcttgttatagtctactcaatcttggtcgatgacccattacgccctaaggtctgatgcatgatgaatagccttgtaagctaacttgaagcccaaccaggaaatcatcaacaacagcgcaacccaagtataaaattgggctttactaacttggcccatttcactgctttagtctcccttcagtgctgtttttgtctactttaggagactcgactcatggatatgagtggtgagttggttttagcccaaaagatgatataggttgccactcactcgcatgggcttgggttgtatccttcacatgaaagaactgctagatctcaaagcaatccgaacttctttattcatctagttacatagatctcgaagtgaccattaattgtgcatagattcatgcataaagaaagtaatgctgtatgaccaaatctggtggggattaccatcgtacgtgaaattggtgcaattcaccggttgggtcttggtgcaaagcaccatcactgttttatgacgtcaggccttgaaacaaatactcaagaccaaggttgatcccaaagaatttttgacgcaaaaattcctcgtacaagtacgtatatatggtgattttttctccgcttcactaattcatgtgaatcacaccagcccaacctcaggatcgcaccaactttttcatgccgtgcaaaaaaatttttattagttttgccgttatactatcacgtatttttttattcacgttattctcgcacatgaatagtggaagacgaagggtggtgggataggttagccgccccaccccaatatgacgcatttacccctgcaaatgaacttaatttcattacctggtcagggcatccactctggccggggcagtaattctggtcaatgatgatgggattttggacattttgcatcgtagcgtgttcgaacgccactcccttcacgaacccttcgctcggcttcccccacgtctttatccgcagcccgttctgcgttcccgtgaacaccgtcgtcttcaccgtcacgttctccaccccctcctcgtcgtactccttccccaggctcccaatgctgccagccaccaacatcgcacgtgtcagactttcacacgtgtggaacaaaagtaattttgatgatcctgcttgcatacatgcatgacatgcaaaatgtgtgcgtgcaccatgcaacatgtaatgcaatacatgcatgttcccttgattacctgatgccatggccaggaccgcaggtgacctgctcgatccatatattcatggtgccggggccgatcgagatgcaatcatcgccggtcttgatgccggccccagtaatcgtgacgtcggtggatccctggacatggatgccgtcggtgtttggactgtttctcggagctgtgatcttgacaccttgcaaagtcaccccttggcagtcatcgatcacaatgtggaacatctcgctgttaatcgatgacagcccactgatcataatgttcttcgagccatggaaggctaatgactgtataaagaaatggtaaattgaggttatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaataatttattattaatttttaaataaaatatataaaaataaataaaaaaatatatatatacaaaaatattataaaaatatcaataaatatttaattttatgtataaataaagctaagtaaaaaatattaccttacgtcatttgcaaaatgattttgattgtgtaaaaatctcaataatctcttccatattaaagattaaagaataaataaggagttaaaaaataaattaataattatttttttaaaaaaatattatttttaataaaaattaatatattaatttattatatggtcttttttcaaattggtggactcgtaatgtacataagactaaaatattggaggggccactatatatataaatatatagataatattttttttgggtggagaattctttcagttgactgcgtcaccattgcatgcgaatacatatcctgatgtatattttcaatcatcaagataaaatatgaagtttgaatcagtatacccctcgactcgcaactctgaagctcttccaaagatcagaaataaatttttaattcttttcaaatatttaaggacgttcttcacaattattctgtacagtaaattttttttttttgtatcgatagctcaggaagctgagaaagccattgcccaatttctggattccttcattcaacagtacttccacgtacttttcccgtaaagaggaaaaaaaaaaagaccttttatttggtgcctcaccaaatggattaatgtgcagtagacactctttttgaaatcacttttgagtgcacgaagaataccaagtatacaactggtagcgtatttcgtagctggtaattccgtctattctcgtgccacatgtttccacatagtgagaaatatcaatgggcatccttgggttgggtattgagtacatcaaccataataaacacatgcggtgcaaagaatagtaggagagatccgggttgttcttaccacttttaggacacagttttggcgtgccaataggcttcaaaactcctagtgtcctacggcttatgtagtatgtatgctgttttttgtgattagtgaggcgttaatgaacggcctgatgttcacttttattataatcaaccaattaaagctaacttgagccaggtaatttggttatatttctccaaagaataaaaagaaaagaaaaagacgagaggagaaaggagaacatcttgcttctcatttggggggcctacaccccaacaagggaaaaagaaagaactgaagacaaaactagagcaatgggaactgaattgcggctaattaatgctgaatgaataaaaagacagttcggtggacaataatctagtttcagttacttgcaggttttcctctgcagacttatcataagaacttttgaaaatattgtcttgtcatataaacttgcattccgtcctcctgaaggaacttgctaacaactcatgaagaccaccgagtcaccctttcaagggaccaaacgcaagaatcaagcccctccttccctactaaacttggataacagccatataagagctctaaatgacaaaaaacaacattctcacgcctcgcttacttccttttcctgccaccagatcagaaccatcccctgatcctataaataccaactccctgagaccatctggctccatccaagtccctccaaacccactcatacctatatctcataatctccttcctttaagaccttctatactttcataaaaaaaaaggagtccaatgactcaaatcatgtgctccttccgcctcctcctcctagcaattctcatgatccatttctcctcatcagtaaaagcatcttacgacgttacttcctttggtgccaaacccaatggtcggacagactcgaccaaatcattcattagtgcatggactgccgcctgtcactcaacaaaccctgcaaccatccatgtaccctccggcttcttcctgataggtccggtcaccttcaatggtccttgtaggagcagtaggatcaccatccagatcgacggaaccctcgtcgcaccatcgaattatgctaatcttcgcaatcttgaacagtggattttgttcgatcatgtcgacggcatctcggtgtacggtgggaccatcgacggccatggctcacctctatgggcctgcaaggccgccggccggaactgccctgccggtgcaagggtaggtggcataacactacgaaatgacccatttaccctcacaactttttttattcttggcactaactgctgttctacgtacgcagtaaattgagctgaccatatattatattgtgctcctctccatgcagtcgttagtgttcaggaactcgaagaacatcttgatcagtggactgacgtcgatcaatagcgagaggttccacatcgtgatcgatggctgccaggtggtgacggtgcacggggtcaggatcacggcccccggcaacagccccaacaccgatggcatccacgtccagtcctccaccgacgtcacgatcaccggagccggcatcaagacgggcgacgactgcatctcgatcgggcccggcacgacgaacctatggatcgagaaggtcacttgtggacctggccatggcataaggttaggaaacgttacaccaacagcacgtgaaacgtacgttaaatttgagtttgacacgtataagatgcttacgttggaacactcacacgtgtgatgctggtggctggcagcattgggagcttggggaatgagtacgaggagaagggggtggagaacgtaacggtgaagacggcggtgttcacgggaacggagaacgggctgaggataaagacgtgggggaggccgagcgaggggttcgtgaagggagtggtgttcgagcacgccatgatgcagaatgtccgaaatcccatcatcattgaccaaaattactgcccccatgagaaaagatgccctggccaggtaaagaaattaaatccaaatccaagggtaaacttgtctcgtaataacggttaacgtattctatcattgtctctgcacaggatatcacgttcggtattctcatgaacttcaaatggtttcttttgctagagaccaaagtttacatgggattgcaaatttaaactttaatttctgaatggatagattttttaatgttgaaactttcttttttgttctctctctgtttgtagaattctggagtgaagattagtcaggtgaactatatggatgtccaagggtcatctgcatcacaagtggggataaactttgactgtagtgccagcaacccatgcaccggaattggactgcaagacatcaagcttacctacggaaacaagccagcaaaatcgttttgtgagcatgtccatggtactgcctctggttctgttgtgccaagttgcttctgactcttcgagttggaatagtatgtatagatcgtatgtcagagtatgcatgtgttgatgaaatgggtgatgtaggattcgtaacttttcttatcctccatgtccaagcgttactctagtagacatggaatggaataaatatttaatggattgatatgtgttttttatttataataatttcggcctaaactaacgttctcattcatggtccccattaacttcggaattaatattcgtggtgcccaaaaagtcctcaagagtgggcccagcttgggtctcaaccttttccctggaattacaaaggctcaaatttctaataaggcacgaatttcagaagtcagatcaaagcaacggagaccctaaaaacgaacgtaccccatccgtacgttgttgtttcagagaaacgaaaattaagttcgaaattttgtcctacactcaaaaacaagccctgcaaatccgaaagaacgcggtaccacgtgaaaatcctgttaacttcttaccgcttattgttgctgtagatttctctgattagaaatacaatcatctaatcagaaagaaatatgtttgtataatttttaaattgaatctctctaattaggaatgcaatcgtctaattagagaaaaatatatttgtataatttctaaattgaatccctctgcttaggaatgcaatcgtctaattagagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatagtatatatatatatatatatatatatatatatatatatatatatatatatataaatgctatagctatacatacatacatacatataatccgtaagtgtacatataaatacccacgaaaacatccaggcaacctctccatttattcgtagtaccgtctcatggctcaactaatccatttatttcttctcctcctagtatcctcctcccactaccactcatcagaggaagcagctaatcaccataacatcatcgactacggcgctaaaccagatggcgagacggattcgaccaaatcattccttggtgcatgggacgccgcctgcggctcgccgggacctgcgaccatcctggtgcccgccggcttcttcatggtggatcacgtcactttctacggtccctgcaagagcagctacatcactgtccagatcgacggcacccttgttgcaccaaccgattacgccaactttggaaagaccaagcaatggatgatgtttaatggagtccagggtctctctgtgtccggcgggaccatcgatggccggggcaagtctctctgggcctgcaagaattccgacggggactgccccgacggttcaaccgtacgtttcctcgggcggtccttcatttgatccttatttctttcctattgtaatttattctccgtcttaactcatatgataacgtaattcgtcatttaatttcttcatgcagtcgttaacgttccggaagtcaaagaacgtaacgatcagtgggttgaggtcgatgaacagcgagatcgaagactgcgagggggtgacggtgcaaggcgtcaagatcgaggctccggaggacagccctcgcaccgacggcatccacgtccacaagtccaccggcatggcgattatccggtccgatatcgggaccggcgatgattgcgtctcggtcggccccgacacgacaggcctgtggatcgagcaggtcacctgcgggcccggccacagcataaggttcccgcgaaagatacacgtacgtacgtttgcatggtgcgggtaaaccattgcatgtcgtgtatgtgagtaggatcaacaaaattaactgtgtttgacacgtgtgggagtcttttagatgttgtttagtgcctgcatgtgattgctggtccgtggcttgcggcatggcagcctggggaaggagcatgaggagaagggggtggaggacgtggcggtgaagatggcggtgttgaccgagacgacgaacgggatgcggataaagacgtggggcaggccgagcacggcattcgtcaacaatgtgtcgttccaaaacgtcacaatgcaaaatgtcaaacgtcccatcaatttgatcaaaattactgtccccaccacgagggatgccctggcaaggtaattcaattcagtctcattccaggggcgggggtaacatatctcgttaaattttgcaccatagaggccatgtgaccttgaatgcaggactagcatgcagtgaattctacttaaataatgataaaaaaaataattaataaaatatattaataataaataattatatatatatattaaaaaaattattttgatcatttaatcagagagaacagaaaagaaaggatgctatcagtgatgatgagtagaatcggccttgatattttttagatatgagatcaaataaaaaaataagatcttctcaattaaaaattaatatattttaaatattaattattattaaaaaattaatctatgtgcaataattttttatagatatgttcgttaagcagcatataaaattcatcattaatctatttaattatttttttattataatattataaaaaaatatttttgtatctcactgaaacattaatgcaggtctgggacctagggcgatcacccaattcgacctatcccaaggtcgttcctgaagacgaggaggtatgactgctgtagcttcagtattttattttgaaaaaaataaaataaaattcaatcaaagattaggatggccaaattagggtcattatcttagatacaaccgagaatgatgattttaaaggggtttggatggacggatatcaaaggttgaaagctattgctctttagcatataattaatggctaacgtaccttcaaggaagaaaaaataatggctaacctcatgtccctagcacaaactatggtaagtatgatattatctgtagttaatagaattagacaaaataaaattgtgagaatgacatgttatttgagattggacacatgtttatgatgattaggtaagtctttgagctttgctgcccatgacttgctaaatctaggacttgctttagatgatctaaatcaacaatgtttgggtagagcacaaacttagaaaacctacttccagttggttgtgggctgaagtagcctcacagtccgatagttaatatacgtcacaaattttatcaagaagaaaaattttggtggctgataatttaacataatatccatacagtatcatagaattttttttctttttcgagaaccgtgctaacggaagctccatacttctatacattttattcctctgtttttgggggtttgggttccttctccatcaccatttcggtatgattcgagcatgagaaaacccaagcatttatagggaccagcctgttgggagatggcatggtctgcaacatgagtaagagttatggagagaaatccatttttgtgtctttctctccaaccttctattatctttagacttttctatttattgaatccgattattttgtcacaaattgcaaggcatagtaacaaaagtacattttctaaacttcattatattttttttttgatacaaaaagcttcactatgtttattgagacttggcatgcactgcaagtactgtacaagtgattgagactatggatagctccaagtttttttttttcctctcatagttgaagtagagcaagttcgcaatatatttatcctatttgataattctaagattttgcatatcaaataactatactgtgccactgagtcttaatttcgataattttatgactcaagtgatcataaataactcgatggcacaacaaaatcagaggctgtgccatcagcatgactacaagaagattttgcttgctggtctccatagatgagcttgatgtcttgcagctcaatttcactgcatggattgctttcactgcagtcaaagttcatgaccacttgtgatgcagatgaattctatcgaaaacaaaagaaaatgaaagctcaaaaattcatagcaaaaaaatttttcaattttaattgaaaaattatttttacaagttccagcatctagctctcgttatagtctactcaatcttggtcaatgacccatcacgccctacggtccaatgcatgatgagtagccttgtaagctaagctgaagcccaatcatgaaatgatggacaacagcacaaccaaagtacaaaattgggttttactgacttggccagtgctttactctgtcttcagtgctggttttatctacttcaggagaggcctcagactcaactcatggatatgagcggtgagttggttttaagcccaaaagatgacataggttgccactgactcgcatgggcttggattgtatctttcgcatgaaagaactgctagatctcgaagcaatccgatcttctttattcaattattgatatagatcttgaagcgaccattgtgcaatccaacgatggcttcatgcataaagaaagtaatgctacatgaccaaatctggtggggactgccatcgtacatgaaattggtgcaattcaccggttgggtcttggtgcgaagcaccatcacttttatgacatctggccttgaaacaaatactcaagaccaaggttggtcccaaagaatttttgacgcaggaattcctcgtacaagtatgcatagtgatcttttctccgtttcactaattcatgtgaatcacacctgcccaacctcagcatcgcatcaactttttcatgccgtgcaaaatatttttcaggattagtttcgactggtgtcctaatcaacgtaaaagaaaaccgttatcctatcacgtatttttttattcacgttattctcgcacatgaatagtggaagacgaaggatggtgggataggttagccgccccaccccaatatgacgcatttctccctgcaaatgaacttaatttcattacctggtcagggcatccactctggccgggccagtaactctggtcaatgattatgggattttggacattttgcatcgtagcgtgttcgaacaccacacccttcacgaacccttcgctcggctttccccacgcctttttccgcagcccgttctgcgttcccgtgaacaccgtcgtcttcaccgtcacgttctccaccccctcctcgtcgtactccttccccaggctcccaatgctgccagccaccaacatcgcacgtgtcagacttccacacgtgtagaacaaaagtaaattctatgatcctacttacctgcatgcatgacatgcaaaaggtgcatgtgcgtgccccatgcaacatgtaatgcaacacatacatgttcccttacatgatgccatggccaggaccgcaggtgacctgctcgatccatatgttcgtcgtgccggggccgatcgagatgcagtcatcgccggtcttgatgccggccccagtaattgtgacgtcggtggatccctggacatggatgccgtcggtatttggactgttttccggagcgatggtcttgacaccttgtaccatcactctctgacagtcatcgatcacaatgtggaacatctcgctgttgatcgacgacagcccacttatcatgatgttcttcaagccatggaaggctaacgactgcatgaagaaatgatgaattaaagttatcgcataattaagttaaaacattgatgcgaagatggcaagaacaaaagaaaaaggtcattccacgacgctagcgtgggaataatcattcaaaatacttaaaatttactatcgttacttatatgattttaagatgattttataaaaaaataaaataataaaataaaaaaaaaaattgagaagatattatctgaatcaaaacaccatcctaaaatgcgattcaacctgatcatcctctgacgaaaacaattgttggagaggcaaatgcaatatatttttttcagatgttcaattagaaaaaaaaataaaaaaagaaaaactatgaattttaaaatagctagatgcagagtctatagatactgtccgaattatcaaagaggtgtcgtagttccaaagagataaatattttaaaaataatatatttttttgaaaactaatgttttctgaatagtcatcccttcggaatggagtgttaaataaaaaaattaatttttaaataactaaaatttagaaatatatatatatatataactccaacagctagtactgaccgttgcaccatctgggcagtccacaccaccagccttgcaggcccagagaaactttccgcggccatcgatggtcccgccatacgccgagacaccctcaactttctcaaacgccatccactccccagcctttgcaagatggtgcaacgatggtcccgtcgatctggatggtgatcttgctgctcttacagggaccactgaaggtgatgggacccactaagaagaagccatcaggtatgtggatggttgcagcctccggcgagccacaggcggcatcccatgccctaaggaacggcttgttgaacgtatataagtgggtgattcaaagtgtactaaaatttaggaacgtggtctttatgcatatcttccatgatctacttagttacttagttgagttagtagctgatacgtgaccgagtgtgaaggcccatgacttgtagtggggtgttagttagtaatggatgggaacgtctgttaccatgaatgtctataaaaaaaaagtactgtattgaagtctttgacaaggcattaatgaagtttttgttctacaaaaactgtgttaactccgattcattgcttgtgtagtgttctcatcgcaatgaactaattccaccctcctcttcctttttgttttttttcccgatatttttggtatcagagcagccaggttctgattacgtgtgggcaaagaaaagataagtgattggagttgttgcagcttgaagacttgtaagtcaaattcatggctaatattgttgtgaggaggtaagctgttgggtagcaacatggcagcctttggaagttccgtaagtatttctcaactctcaattcctatctttaaaggtgaatgttaggaattttagaacattaaaatgaagactttatttctatcacaagacctttaggatttggttgagaatggatatgctgatccagatgaagaagcaaagttaagagaaaacagaaagaaggatttcaaggcactgtttttcattcaacaagcagttcatgagtccatcttctcaagaatcgctgctgcaactactgtaaaagaagcttggacaatattgctaaaagagttttaggggtcgtcaaaggtaattattgtgaaacttcagtctcttcgtcgggattttgaaattttattcatgagaaacaatgaatcgctgcaagaatttttatccagagttacatctattgttagccaaatgaaatcgtatggtgaaaaaatttctaaagaattagtagttgcaaaagttttgagaagcttaactccaaaatatgatcatattgctgctgctattgagaaatttaaggacttatctgttttttcatttaatgaattagagggttctttgcaagctcataatgctagaatgaacagatcaactgagaaagtcgaagagaaggcatttcagttgaagggggagacctctacactcaaagataaatccgatagagtcacaggaagaggtcgtggccgaggtggattctgtggccgaggtcgaagtcaaggctgaggctgtgggcaatttgatgatcaccgacaatcatccaatgagtatcgagacaaccggaatagaatccaatgccatcattgcaagaaatttgggcatgtagaggcaaattgttggaacaaagaaaagtatgtcagttatgcagaagaaaaagaagaagaaagtaagttattcatggcttgttatcatattaatgatgaattaaatgagaagttgaggtttgaagatggtacaaaaatgataaatgcaaatttgtttagaagtttggttggtggcctgatttatttgatacatactggatcggatatcgcattttctattggtgttgtttccagatttatgcataatccaaccaagcatcattttggagccgctaagtgaatattatgctacatcgccggaacaatgaattatgaaatttggtattcacatataactaattttaacttgtttggattttcagacagtaattgggcaagttctgtagatgataggaggagcacttctagcaatatgtttatttttggatcgggagctattttgtagaattcaaagaagcaagcaataacggccttatcatcttctgaaatagagtatgtggctgaagcattttcagcttgtcaagctttatagctgagaaggctatttgaagatctttgtcaatttcaaaaaagaactactaatataatgtacgacaatcaagcagcaatagcaatgacaaagaatccaagttttcatgaaagaacaaagcacatcgacattcgacatcattttattcgtgacttggtagctaaaagactggtagagttgaagtaatgtaatacacatgaacaagttgcaaatatttttactaagtcacttccttataacaagcatttctacttcagatcactccttggtgtttgcaactttgaatcaagggagagtgttaagcgtatgtaagtgggtgattcaaagtgcactaaaattatgaatgacttgtagtggggcattagttagtaatggacggaatgtctgttaccatgaatgtctataaaaaaaaaaggtactgtattgaagtctttgacaaggcattaatgaagttttcgttctacaaaaattgtgttaattctggttcattgcttgtgcagtgttgtcatcgcagagaactaattccaccctcctctttcttttgttttttcctaacacgacttgctcgaatccatctcaccatccggtctagcgccgaagtctgtgacgtcgtagactgcatttactgatgagaacaactggatgaagaggagtatcacaacaagaagcaaagaattgatgatgagtttcgccatgagaaggactccagtatatgatcagtctatgaaggaagttattagactgagggagtagagagatgtttgaagggagatggatggtgtcttgttgcttggtggatgtttatatgtagaatatcttgggaggtttttgtggctgcgagaagaagcaagcatccccgagatttaagacatggagaagtgggaaaatcccttctttattccacagtttttgtagaataatggaactcaaccagtccttgaagtcccatgaaggaaacggaacgcaattgtatagtgataaaaagagttctgaaggcacgggtgttggatggatgtctggccaggataccacctcccaagatcctttcagtaccacgcgatgcagcaggaagaaagaaaaaacaaaacaaaaagaaaaacaatcaaaatacgtggatcagtcacaaaagagctcgcctccacggggcatgcaaacttcactatgaaaaagaaattttacaagaggagacctcaccctcaacccttgtatacccaattctctctcacctgaagttctcctcacaaaagctctctctctcttggagaccacctgaacccctgaagagcctggcgaccgctgtcaaggagcctcctgctccttctctcacagcgctctcgtctctctctcttctcggattcgtacggcgcgagaaaaccaaccacctcccctctctgttatcgatcagccctatttaaagggttaaacaaggtttaaaacttaattagagaaggattaggagtcataaacaaagccagatagcccctggaccgtcggatcaagatcgggagccacccacgctctcagatcgcgcttcgatccacggaatagtgccgtggaccgcgagaaatgcgtgggaaacgcccacgcggtttacaggcccagctgtggaccgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatacctccagattaatacgacttgtttacgacccgtgaatatgaattgtcagccctataatagcctatgtatgctgatttttgtgattactggggctttgggtgaacggacctgatgttcacttttattctagtcaaccaaagcaaacttgagccgggttttggatatatttctccaaagaataaaattataaaagaaacgaaaaggagagggggaaaagagagaacctctagtttctcatttggggaaaaggagaggaggaaaagagacgaaaaggaggggggaaaagagaaaacccctagtttctcatttggggcctaccgcctacgccccaataacagaaaaagatagaactgaaaacgaaactagagacgtgggaactgaattgcaaccaatgctgaaaaaaaagacagttcggtggacaagattctagtttcagttacttgcaggtcctcctctctagccttatcatacaaacttttgaaaatatagccttatcatagaaacttgcattcggtccgcctgaaggaccctgcataacaactcataaagacaaccgagtcaccctttcaagggaccaaacgcaagaatcaagcccctccttccctactaaacttggataacagagctttaaataacaaaaaacaactttctcactcctctctctctctctatctctctcttatattagggcaaagcttacttccttttccagccaccagaacagaaccatccactggtcctataaataccaactcccccagaacacctggttccatccaagttcctccaaaccccctcataccgacatctcataatttccttcctttaagaccttctatactttgataaaaaacaaaaaggagtccaatgactcaaaacatgcactccttgctcctcctcctcctcctaccaactctcatccatttctcctcatcagtaaaagcatcttacgacgttacttcctttggtgccaaatccgatggtcggacagactccaccaaatcattcattagtgcatggaccgccgcctgtcactcaacaaaccctgcaaccatccatgtcccctctggctttttcctgataggtccggtcaccttcaatggtccctgtaggagcactaggctcaccatacagatcgacggaaccctcgtcgcaccatcgaattatgctaatcttcgcaagcttgaacagtggattttgttcgatcatgtcaacggcgtctcggtgtatggtgggaccatcgacggccatggctcccctttatgggcctgcaaggctgccggacggaactgccctaccggcgcaacggtaggtggtaacactatgaaatgacccatttaccctcacagcttttttattgttgccactgactgctgttctacgtacatagtaaattgagctgaccatatgttatattgtgctcctctccatgcagtcgttagtgttcaggaactcgaagaacatcctgatcagtggactgacgtcgatcaatagcgagaggttccacatcgtgttcgatggctgccaggcggtgacggcgcaaggggtcaggatcacggcacccggcagcagccccaacactgacggcatccacgtccagtcttccaccgacgtcacgatcaccggagccggcatcaagaccggtgacgactgcatctcgatcgggcctggcacgacgaacctatggatcgagaaggtcacttgcggacctggccatggcataaggttaggaaacgttacaccagcaccacatggaacgttaaatttgagtttcacgcgtataagatgcttacgttggaacactcacacgtgtgatgttgcatgttggtggctggcagcattgggagcttggggaagcagtatgaagagaagggggtggagaacgtaacggtgaagacggcggtgttcacgggaacggagaacgggctgaggataaagacgtgggggaggccgagcgaggggttcgtgaagggagtggtgttcgagcacgccatgatgcagaatgtccgaaatcccatcatcatcgaccaaaattactgccccgatgagaaaagatgccctggccaggtaaagaaattaaatccaaatccaagggtatacaaaacttgtctcgtaataacggttaacgtatagaataacgtattctatcatgttcggtattctcatgaacataacggtttcttttgctagagaacaaaagtttatgtgggattgccacttaggctaattatcttccttgtgaaactttaatttctgtattgatagattttttgatgtttatactttttgtgttctctctttatttgtagaattctggagtgaagattagtcaggtgaaatatatggatgtccaagggtcatccgcatcgcaagtggggataaactttgattgtagtgccagcaatccatgcagcggaattgggctgcaagacataaagcttacctacggaaacaagccagcaaaatcgttttgtgagcatgtccatgttactgcctctagttctgttgtgccgagttgcttctgacttttcgagttggaatagtatgtaatcgtatgtatatcagagtatgtgttgatgaaatggttgatgtaggatttgtaacttttcttatcctccatgtccaagcgttactctagtagacatggactggaataaatatttaatggatcgatatgtcttttttattgataataatttcggccttaaccaacgttctcattcatggtcccaattaacgacgcaatattcgtccagtgcccaaaaagtcctcaagggtgggcgcagcttgggtctgaaccttttcccaggaattacaaagtctcaaatttctaataaggcacgtttttaagaagtcagatcaaagcaatggagaacctaaaaacgagccccatccattgttctttaagagagacgaaaacttagttcaaaattttggcctacactcaaaaacaagccctgcaaaccgaaagaacgcagtaccacgtgaaagtcctgttaactacttaccatttattttcgaaggttccttcgtaagccagttttgtttacctcgcaactctcccgaggttgctgctgtccagaattcgactagggtggcaatttgctcccagctccatctcgactctaatagaatgggttttagtacccaacctgcagcggatccggatagatgttggtaatgataaaatccatcttcaaatcctatccgtgtgtgtatatatatatatatatatatgtagtcttttcacaaattccttcctcaccatttgatttatttattttaattgtgagaaagattgaacgtatgaagagatatgctatgatgcttagttattcattatttagttgatttcttttttagtttaagggatatttgactttttcttaaaaaaataatatttctgtttgttatgttttttattttggtttgttatattttgagttctatctttggctcttattttaatgttatgtgaagtactaagtattatttttatatttttttatttatttgctgcttggctccattttgtttcaagatgagtactgaatggatatagataatggcctatctaacatgttgccatccctaaatataaaaaagagagaccagtggatcatcattacatcaaggaaaatagctatttaagacagttacatgcacaaaatagccacaaaataaaccaaaaaaataggcatcaaacgaggcttgttgagaagaagagaggaaagttgaactgcaagccttcttgccatccattatctataaggaaatttgtacattagaagcaatgtttgaaatatgcctaaaaaaaggagagaccaaggacacagatgctttctgtacaactctttgataaataaatatgctctcaaattaaatgcacgaccattgttccaaattaagtagaataaaatattttaatccatttgttccattttaattcaccaaatactagacagtaaccaatatatcccaaagatgaggtaaatattttgaaagattagtataactactttctggacataatctcgagtaaactatatattctatgcgctttagtttaaaatcaattaggttaaagtaagttaatcaatttattttggattaattaattctacaatatttgtgctgcatcacagtacaaagacaacacaagtcatggccaacacttgggcgtcaagagaatggttgtatataggcttcttttaaaaaatgtccccttatgaatttagcaaggagcttacatgaatcttccttatatattttatatgtagaaaatgggcatctatagaatgtggcaaggagggtggaaattttttcattgacctctttctctagcttaatttagggtgcgtttggttagccattaaaaaaatattttttttactttttaattttaaaaaataaaaatcaaaaagcaatatttgataacatcatgaaaagtaaaaaatcaaaatcaaaataatcaaaataattgctttatatgcaaagcaaaaattttttgctttctaaaacttacttttttacttttttcacttccccgcatctaaaacgccaaaccaaaaagtaaagagcaacctaaaaagtcaagatatacaaaatcctaaaggatttgagataatcatcaccagatctccaaagccagtcatcgaaatggtcagcaacaaaagccactacccaatctgttatagtattcgcttctcggaagatgtgctggactcgcaccacaacagtttggtgaaggatagtccagacatttcgagttagcgaatgaatctcgaactgcgtggcacctccctgaatcaagagataacaatagcagagtcatcctccagaaaaattctctccgcatgaagctgctacctggcaaaagtgacatccactaaagctatacgaagctcctccatcgaaactgaagcctcaaaaaggtgagatccatcaaccatcaaaagtctgtcatccggaccacggatgacaaagcttgcaccgcctctcccaactcggacactaccatcaaattttatcttaacaaacccctaaggtaggggttctcaagaaatggatagaaccctacggatcactgtcggacagctaaatagcttcagagtccaagtgtgtctagggacagagtggcagcatcaaagtggcagtatttctgagctaaaaagactgctctctcaagaacccaacgagcagaaatcacctcaccatcaaacacaagactattttgagacaaccaaatcggtaagcaatataaatcatccgtccaccatccatagccatccaatcaaccatactctgatggatcaagccaaggaaagaaatcaaccaagggtcagtacttgcctcccatggaaaactgtctgtctgtctccaaatgattttcatcctaagacatcacaggacagcgtgctccacagactcgtccttcatgccacagaccgaacacactggctgaacctccatatctctctccctgaaaagtgtctaagtaaggaggcagtcctagacaggttttcaaagaaaaatctaaaccctcggatgagtggcaactctctaaatccagacagactcaatccatctacagcgcatcggactgtacaataaagaaaggtccctcaatggaaccctcaagcagcagaaatatctgcagaccctcacatcctgtatgaggtaaacaggaatcgagatggcaaggatcctctccgccagtggctgcccgaagagctgagtgatctcctgtattctccagctagaattatcaatggtgataagatcagacaccctcatgtgatcctccacctcgatgctgacaagagtcggccaacgagataaaggaatgctcaaaactcaggcatcctaaatcacccccaccgaacgaccatcacccaccaagcatcggatttgatccatgacatcaggcccccgagtacaaatctcacaagcatcctcgggcaagctggatgatagttctatggctcgacctaccatagcaagctctcatcaccgtgctccataagcaattcggctggatcaaaaatctagccacatgtctggcaagcagagcctcccgcttcgtcaataaggaatagatccccaggccatcatcctgcatgggctgacatactacctcccaaaatagcagatggacctgacaacggtcacagtgagatccccataggaagttgcgaaactattgctccagttccctgatacaagcaatggggacaaccatgtgggacaataaataaatcagaataaagctcagcactgatctcaccgaggtggtcctgtccatgaaggagagggtggtggcctaccatctctgaagatgctcttgaatccactgctctaggggtctacactcagcctgtcgtaaacaacgccctatgatcggaaccccgagataggtcaatgacccagactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgataaaaatattttcatcataaataatcaagtatttatgatgaaatttttttttatcatcataaaaagtgattatttatgatgaaaaattttattataaataaagactaattttttattttttaaaattttgatttttttaactattggcaataaaaatattttcatcataaataaaaatatttatgatgaaaattttttttcattacaaatactcaattatttatgatgtaataattttatcataaataatctttgcaatttttaaatttttaaattttttattttttcaaatattggtgatgaaaatatttttgttgggaataacattattttgataaaaaaatattttcgatcataaatacttaaattgttaacgatgaaaatatttttatcataaatatttaaaaatataaaattaaaatgaatgatgtattatttacgatgaaaatattcatcgtaaataattcgtatttacaacagaataattttttcatcgctaatatgcaactatttgtgatgaaaaattattttcatcataaatattttattatttatgatcaattttatttttcatcaccaataatattattgacgacgaaaatatttacatcgcaaataattctgtcgcaaaaatactctttttcttgtagtgtccagcttgatggccatgagactacgataatatggagctcgctgaaggtcatgcatgaacttctagaccagcaaaatattatcgatgatggaccatcctacttcgtgctgatcaagtgaggcatcagcggcttcagccatccaaccaaaattcttacacacactttgtagagggtcgtacaaaggcaaacaggtctgaaatgctcaggaagcacagcgtgcggctgtttcagaatgagagtgacaaggatccgcttctagaccttcagaacttttatagagtcaaaggccacctacaccgcctccactatctcctcctgaatgatcgaccagcactggcgaaagaagagaggaggaaaactagcaggtcccggggccttatcctctccaagagaccagggggcctcatgcacctcatcaaaagatacaggtctagtcaaaatcttgttctcctgtgtagtaatacagaccatcgactgagcatccaaaatgggacagtcctcatctagcgacctcatctatcgatccctgaagaagtgaaagatctcctttcggatccctccactatcagccacaataccaccgtcactcctccgtagctacctgatgcggttggtggaccttcaaatcatgatagactgatggaagaatctgatattccaatccccctcccgaatccactgaaccctagacctctgcctccagtagatctcctgttgtctcaggagagagtgatgctcaaagagcttacctcgtagcttccccaactcatgctcaagtaagccacctctccagtcttccctcagctgtagctcctcaatatcagcctcaacccgctcaatctgttggaagatgtcactcatctcccaatggttccacctgaggagtctacatctagccagctcaagcctgcgagtcatcctgtacctcgtatctccgtggatcaacatcctccacacatcccgaatcaagtctcaagatcccggataaaagatcaaaaacttctcaaactggaagggtgccctgagccagtccaggctatctgtcaaagcaagaatggggcagtgatccgagacaatcctagatagatactagacagagtactcaggatagcgctggatccaatcagtcgaagccagtgctcgatcaatcctctcccaaatcctagtagacccatgtcgattgttacaccaagtgaatctcgaaactgtaaaacaaaggtcgaccaatgtagtactgttaatgaattctctaaactccctggactctacagtgtccctctcctatctgccaccgcacttctcgtgggggccaataatgcaattaaagtcgctagccagagaaggcactccctgcaatgggagtctagtgatctccacccagagtaccctccgatctctgtacttggtactcacatagatacttgagaggaatcaggattgtccagactagtctgtgatgatgaggaccacctgctgcttacatttgtgaaaaatatcaatttgaatcaagcctcgatgccacatcatcaagatgccacctgacaaacctcgagactccacggcataagaactccaggccatggggatctgtcgtctggcccgggccagcccagtctcagagaggcgggtcttgcttagcacacaaatttcaggaacatgttgctggatcaaccgattgaaggtcgatcggaaggagggcttcctcgccctccgacaattccaaagcaatatcctcatagagaggacccactaggaagggggcctttcctcataccccctcctcaagagagttcaccacatccactacatttgaagattcctctatctcaacgattgctctctcaatagtgataacgtgtcagagtctagccatgatagcctcgtgagtgagaccctcaatctccatcctcttaggtgggacgccctccatcatggactcaacactatgctccgacacccccacctcctatgggccaccaggctcaccatcctatcccccgcacttcagtgggcccacctccacctccgatcaccctccacctcctccaaccagaccaagttgtccagagcaagccttgcttcctgtacaccacatcccggtcgacaaccaccctccgacacatggaagtggacaatggagacaaactccatcaaggctctcaaagacaaaaagttgccagaaagggccgatcggacccgtaaccagaaccctcggtcgcagtggacagccaaggtgcaagttggatgaatgcacgggtgaaccccagcggtcctcgatcgtaatggacggtcaaggtcaagttggatgcatgcacaggtaaatcccagccgctggatgtctaccgtgcaatcatcgagaaacaccaagtcaccagcaagcctctacacctttcggatggcctcctcatcccagtactccatcggaagccgggggaggcacacccacaccagggccatgaaaattatgcctttcgtcggaaagaaactaggtctccacagctcaagggcaagggcttgccctgccaccgtctatggccactggagcacctggtcttgctctgcttcctccccaaaccgtgcaaagaacaatcccttctccaagccgtacaccatgatttcacccttgagagctctccagagtcggaactccctggccaccaacttcggcggcaccctccatccaagacccttactaaccaatgtagttgccttccagcatgccaacctctcccgaagagccgcctctgggactcgcaccacctggtaagttctgtcacttcctccgatgatggctctggtgaaacccacacattctgcccctgtacaaccccttttcaattcctttccgacctgccttcatctttcaaacgatcacgcatcttcctcaccatgaaaccccagctcgacagcttcgatagcagtctggattgctggcgatcacagtcagaagaaaaatagcatgaatcttaaagcactcctaagtgcaaattccaaccaccgatgcagggatacgatcttgagttgactcaaaaaaaatacaaactagaagattgaaagcatgcatgtccgttgtatcatttgcaaactattcctatttcaaaaatgtgatttaggtccactgcaaagtgtaattagatttccatcttaaagttagcaacaataaatagcagatttttaaaatggccgatgacatactgtgttacaacagtgcactgaaacagtcgtcccacctttaccaaaaatgaaataattgtcccacttttgacaagaatctcaaaacgtcaggtgttgctggcaggtcttgaaatagaaattttattgtaatccagaggtatacatgcctaatggtggggcaaaaaaattcaggcctttgccaaatgaactaaattgctaaatattttggaagaaaaatccagagctaaaatattgctaagcacccgtacagtaataatttaatatatatgtatatatgaaagtaaaaattgaaagaaagtaggatagcaatttaagctatccacgtaagcacgaatttattacctataaataccatgtaaatcaaaaaaaatttataaaatattatttaattaaataaaaaaatattatgatgttaaagaattaaattaaaactcatatatgtaaattaaatgatgtgattaaaatccactcttacaatgaaagcccacttttgtaattaaatgatgtaactgataatatggattaatatcaagaatttgaatggacataattttatcatattaatttattaatttaaaaaataattatttttagaagattaataatgatatggtctaaaatcgacacactgcattgcatacgggctcaaaactagttataatatattctcttaaatgtgttgtctaaagcctatttaccttcatcgcttacacttcccttggcccctgtgaactaactccgccgagctttcagtcggaagttatattgatcaatgttacatacataagaaatttttgaagggtgacgttaacgttcgccaccatttctctctcttccctccatagtcctgctgtggtttcctccatagataaagttgatgatcatgtgtcttatgttaccttcgagacaataaccataaaacaaggctccttgcacctatgagtgagccctttcattcccttgcacgcatgggcaaaccgtggcagcaaaggcacagcttagaaattttgggcatgttacctaagcaagagattaaaaaaagcggcaacgatacaagagggtgactaataggctttgttctgtcttatacttctcactgatatctcaggttccacagtatcttttaaattttaaattaaaaaaaaaaatcaaactgaattttacgggctcaacaagttactaatatctctgagagatcaaatataattaaaaatttatatctaaatatacaataatagatgcaaatatcaatataatttaaattttcaaaatatgtcatgtgaaatagcaagctttaaaaatcttactcagtcttcattgactacggcctcgatcaattccgtaataagattcagaagagactaactcttaaatatagaacatccgatccatcaacgtgtaccaatgattagtcccactggctaggcccagaagaggactagctctgaaaatacggctacgattagcccaatgacaagaccaagagattaattttgaaaaacaaacatgcgaacgcatcaatatatgccagcaatcagtctcgactaactaagtccagaaggattaactctgccaacaatcagctccgactaactaggttcagaagaaacgtattttgacgtacagccaacgatcagtttccttaattagatttaaattatagtctaactcgagagtttttctcattatttccacaataattgattttcatagcaagattatactattttttataacaatagtaatttaagcttctacatcttattttcaaaaagtaacaaaatactttttattcaaaaaaaaaactcatgcagaggtgaatatgtataatttttatttttaaaaattatataatattaattaatcttctttccaagtaccgcataatagatttaaaataaaaaaattaatttatttcagattataatttgcaagaatcatatcatccaccttatgcttgacccataatttgaacaatcattttcatgatagcatgcatagcataaataatttctcaaaattttttaaanatttatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatattttattttataaaattaatttgaaatacatgataaaaatctcagagaacacaagaaacttacaatcagtcgaatctaaaagtcataatttttggtatgtggcctgatcctcagatttgtgctctttctgatcaagattaagatccttgatcagatctgaaaaggagaaaaatgcttggtttagattgtaatttcagttggatcatgtgatgaatctaaccatcttagattgatttagattcaattcgattggggtccaattaatggagcaattttaagaaggtaggctttccctttgccccttttttttttctttcttttcttttctttattttttcttctctttttctttctttttctctcttttttttttctttctctttctttctccgcgctctctctcttctctttctttccctcttcccaagccatagagggtttccactaaggggaagggcagagaggagaagaaggagatagagtcaacgatggcggtggcacggtggcagcgacaatgggttgcaagccggtggaatggttcttagcaagggttgatgaaaaactgggagaaatgggataacaatggtttgaaaaagaataatcgatcttaggagggcagcaacactcggcaagagcatgatggttgtggggatgaggaaggaggagagaggcggaggaggttttgatggtggatcaaccgagaggagaatgggatttaaaagaagagggtaggaaagagaataaactcaattaatcaatggataactcgatcgtttgctggcgtaatcaatccaaacaccttcagtcgtccctctaacacacaattcaggccgttctcacggccttatcctcatccatgccatgagattgggtaggggaaaacttcctctattttggtcgaagtcctctcttttaatttttttttttttgaaaagtttcaatgaagtcggcaatctttgctggcttcatgctttaccaggtccaatgagaccgattctcacattcttccctttttatataaaatttcatcataaaaatttgagaattttagatctttcgaagtaaagatgctcaaccccaaaaatttacatataccaagttgtccagctttggtatttctatcaaaccaaaagcatgatcacattattgcaagtaattcgaccactcgggtcaaccataatattcatacagatatttacgcctaagcatagactcctcctgagaatacttcataatttgacatctctatgtcaattctggaatttcacccccttgatatgcaaataaagatcttgtatctccttgattgaaattagtatgattaaaaattttccatcatatttagaattaagatacagactaataagattagcactactaaagcgactaagatattgggattgagatacatgcagtcattttaaattgagttgggatcaattagatgtaaaaatcttatagcaagattgattattaaaatcaattatatttggaatagagcttgaaatgatttcggtataaatactatgatgcagttttgattctacaaaagataatgttccaccttgattaaaatcaaataatcagatgactatgaaggtgatcatgattaggtagtaatggctttaggcaacaatattgatccatcataattatgaaaatgatttcaaaattaaatcataaaaattaaatcataaaaattaaatcttagaaaataaagtattgatatatgattcttatgttgaagtcgagatcataagaagtgaatgaatcaagcaaaatttattcagatacttaatagaccaaattttaatcaataatcaactaaccttatatataaggtgatcaaaatatttcttagcacaatcaatatagtcgtatcatgactagcctaagaatctatagtacttacgttctctttatgaatattttttttattggaggatcatatcttctatcataatatatatcaaactatgatcaatatttttgatcaattttaaatgaccaaaccaccacacttttactatgcaactctgattaatattctctaaaattttttaatgatcatagatttaaattttatgagatccaatcagattgggatccgattagtagagcgattttaaaaaggtagacttttcgattctcacaagtagtataatgtcgaaactagtttctcagattatatgttgataacatcagcatataatccctattggtggaaccatcttagaccagaaacatgctaaatatatgaatgcaaaagtatttttacaaatcattcggtcaaaattttagcattccttttcaacacgtgttcaacataacccattttagaaatataaatacatatttaattcttatattattttttatgataaaacataatatctttgaccatctaaccaaatagatatagaaatcataaaagctattttatcaagcaacataaactgtaattttcttacaaatttcttagaaaatacattgtaaagagtttagtcattttccttatggatgtcaaaatccaaatactttaatctggttacacgattgcttcgagacctaacaaatccaaagccataaacatttgacttagtggtacaccaatatttcaaaataatttctcaaatttttaaaattctcaaagattttaatttttaaattattgccattatagtagagaaaatgtgtcactaatcatatcctatcatgggcaggagagtaaggagacatggtagaagcccctctagggctagcttaaatgtcaattcgaggtagcaaaaaattggtgctaaacacaagggtcctagccagtctacggtaaaacacatatttgacaccttagtttttagctaagagaaccacgaaccaaagagattaagggactaatagtggaacattcaactctatcatgcctcgcccccgaattggacttctacaatatacgaacatgatgagctgtccagtgaaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcagaggaagcagctaatcaccataacgtcatcgactacggcgctaaaccagatggcgagacggattcgaccaaagcattccttgatgcatgggacgccgcctgcggctcgccagcacctgcgaccatcctggtgcccgccggcttcttcttggtgaatcacgtcactttccacggtccctgcaagagcagctacatcaccgtccagatcgacggtacccttgttgcaccaaccgattatgccaactttggaaagaccaagcaatggatgatgtttaatggagtccagggtgtctcggtgtccggcgggaccatcgatggccgtggcaagtctctctgggactgcaagaattccgacggggactgccccgaaggttcaaccgtacgtttcctcgggcggtccttcatttgatccatatttctttcttattgtaatttattctccgtcttaactcatatgataacgtaattcgtcatttaatttcttgatgcagtcgttaacgttcaggaagtcaaagaacgtaacgatcagtgggttgaggtcgaggaacagcgagctgtaccacatggtgatcgaagactgcgagggggtgacggtgcaaggcgccaagatcgaggctccggaggacagcccgaacaccgacggcatccacatccacaagtccaccggcgtgacgcttatccggtccgatatcgggaccggcgatgactgcgtctcggtcggccccgacacgacaggcctgtggatcgagcaggtcacctgcgggcccggccacggcataaggtgaggccagtgggacgagttagggtcgtatcttccgcgcggaagaatgatatccaccttcctttccgtgcatccgatctttggagtgctttgcggagcatcattctttcccgcgaaagatacacgtacgtacgtacgtttgcatggtgtgggtacgccattgcatgtcgtgtgtgcgtgggtaggatcatcaaaattaactgtgtttgacacgtgtgggagtcttttagatgttgttgagtgcatgcatgtgattgctggtacgtggcttgcagcattgggagcctggggaaggtgtatgaggagaagggggtggagaacgtgacggtgaagttggtggagttgaccgggacgacgaacgggctgcggataaagtcgtgggggaggccgagcacggggttcgtcaacaatgtgctgttccaaaacgtcacgatgcaaaatgtcaaacatcccatcatcattgatcagaattactgtccccaccacgagggatgccctggcaaggtaatgcaattaagtctaattccaggggcaccgctaacatatctcgttacattttgaaccataccttgaatgattgccacatcatctccttataaagatggacatttctcaaacaagatacgtggatatggcatgtgttacacctcttttgtttgatagttgtctgtcaggggatccgaatacatggcatgttgtgattgggagatggaccctctctacgacctcaagaggggattattttgtttttggtatcaatatgtatatatatataagttacggcttttctgagctggaatttttaaaactcaagatgtctcttttctaaatttgcactggttcaattcttaccataatctctgcttcacctttactttttctcaggattctgggataaagatcagccaggtgagttacagtaacatccggggatcatctgcgacagaagaggcagtaacgtttaattgcagtgcggctaacccatgcaacggaataaggctagaagagatagaactgacatatcgaaatgagccagctaagtcatcttgtgaccatgctcaaggcacttcctttggcagggtcaatcctccaagttgtcttcagtaattttgagcataaaatatatcgaaataaaattttcagttttgttgttcttattatgccaacttaatctaataacgcatgaagttccaatatttgaagctcaccacatattgatatcatatcaggcgttgccaaaatgactgtttcaagatacagcattcctctgatttatcaaatgctttatgataaaattagattgatcatgtaatctttatgactacaaactctgttggctcgaatggttatacaaggcagttctgaaagcagactttgtgccccttatttcagtcttaaattactagttctggtagtaatgctctcgagtttcaccatggactttgatggtatacgagtatttagtcagaattgagctgaattctacctgggtcatgagtcagcacccaactataaaattatgagctatctaagagcatttgttaatcctaaaccgggctcaatctagctaccatgcacggtttagtaacaatgcaagttgggtcgggctcaagctacatgaagacccatccaacctgctcattgagtgggattggatttatattttataaatttggcttatgatcatacatattctaaatgtctgagtgtttcgaattcatttatatgacatatatagatcacttgcatgtttcatataattatatcttcaatcttgttgaattatgtcaaagtgtgtcattgaaatggataaatgattgagacctcaattcaatgaccattaaaactatcccaaacatttgtcccattgatcttaaattcatttttctgcccaatctaacttgatttatgtggcctgacctgaccgacccaaccaacctgctgataacctaaaactgggttgggttgggttggattggatttggttggtacaggattggattcggtatgggttaagagatataaaggttgagttggcatggggtttgcccgcgatccaatctaacccacccaagttgcagccctaccttttagctcctaattaaatctaacatggttagaaccatcccattttgttaggcaattgatgcatatgttcagatttaaggttggtcttgatgattatcactaaactaaaaaatagattggttatatcaatacctaaatacatgactaaaaaaacatataataccacatttttcttaagaaatatacactaacataattaataatattatcataaaagaagtggttacattggcatgtaacatgtgactattgatcaaaaaattgcattaatcattaattctatttatcggctactgaatgatttctttcaaacaaatccttttggagattcttataacagtttcccttaacaatattaactatcagtccaaaattcatagaactgaggaaatgcaggaaccttgatacttgaatttgttttattacaaagtttttgttaaaagtgcttaggtaggccttgggtacttaggcatggccaaggtgaggtcttgagccgttattctttggctgctaggaggagtgacttaaaagcaatccctaaatcataaaatatattgaaatttagaacaatgagaggtatttaagcattataaaattttacaattctgttgctccgtttttcatctagtttaaatttatatctctccaaaatcacagtcatattttatgtggcctattcatatccaaattaaattgaaccaatttgccttatgaaaccttaatattagataggaaaaatatcactcttggcccactttagtggagtcaaattcctggtcaagcctatgctagagtaagttattaatttccttaatttggttttacttgatttatcttgtaaactatcctataaattacaaatgattgcataaagcaaattcataaatatttataaagataaatgataaaataaaattagaaggcatatttagaatgaggcaaatgaagacatcatcctaagaatgaattttgcttctctcatacaggtttatggcgagattatcacaaagtaataatgaaaatagcttggtttgaatcctatctataagcttgatcacatgaaggtctaatgcaaataactcttttgattttcctggataagagacaaaagagcaaggaaaaaattgggagaaggaaattataagaaagaggctaacttactgtaggggaaaaaaggcatgttaactcacacaaggcaatgttagatgtgtgctctagatgccagattggctgacacattcctgtacaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgtatgagttcttaccaataaaaccaatatatgagaaacaagcaaattgacaaccatgcaagcaatgaaatagccaattttttccttcgaattgttttgggaggaccagattcaaaaattaaaaaaaaaaagaggaattgttgtgggagaatattatgggacagaaattcctgcattttatggtgcttgaatgcaatgaatcagaatggtttacattgatttatgctctggaatttaaacacataggatgagcccctgattgactcttgaactctagaaaccttgagttgatataatcttttttattttgttcgaaaaaagtttcttttggtattaatacaagagacttggatccgatcttatcttggccttagttttcagctaggctttccctattctagtcaataaaagaaaaagaaaataaagatttggtgtacatcataaacgttatcttcaacctctactcagacataattcaagcaagtaaatattaattaaaacctaggtctagcccgaagattttggaccctcctgaacctaggtcaatgtaacttgctagtgacttggtcagattgaagctaatctttgacttgaaaccacaccgggtaggattgaatccaagccagtttcagacattaccctatcaactgacaactctatcaccctacgtgtggacatggagacaaaatccattttgcactaaagtgttggtttggtcaaattctgattttcttaacttgaagtagtaaaatatcatgttagccatcgagtttggctgggtccaattgcaacatccttttgaccaactcaccaggagaacatggggcaggtgcagttccaagtggcttggacctaaacctcaggctttaatatacatcaattccacggcaacaatataagaagtatggcctactactatctagaattccaatccaaatcaggtctaaattgggttcgttttgggtcaaatttgggtccacttcatcaaacccaaacctaaaaaatatgaacgcaacatgttcttgagagtcccaaaaaaatcatagttgtggacattttatgaacgcaaagttttctataccatcctttccggtgcttcatagctgtggacattttatggtagaagcttttcaccagcatgcaatcatttctccatgggaacgacttttcggccaggaatttttggtgcatactcccttcttttaccaccaaaacttgcgccaaaattgacgttgggtgatcgtggaccgagacaaacacaacccagcccttgtagactcctttttttttaagttatcgtggaaagttggataaattggtcaaccaaccgaacagagtcatctgtcggttggaattctcctgtttctcccccaagaatatacaatcccataaccatctgctaccagaatacaagctaagttggaatgtagatagtgtataacattaatgaataaatatcctttgtaaagctctaatagccatccaatagcctgggtccctctactatatctttggacagaggaatatctctgtgtaccaaagatccataccttcccaaactcttaaaaatcggccataacaatctcttatcttatgaatccagatcctccagcatcatccaaattaattttttaacattttaagggatgggaatagccacgcacagactcaacacctagtgggttagaataagtaattctgcagctactccatcatctcggttgacaattagaagaaatagacaaccggttctcaagcatttcagcataaaagaaccaaatttcttctgaaaaaagagacaaattctttcattccaaatttgccgagttatacgggcaaccagggctcaatcaagctagactttatgttacactccttccacaacaacttccaaggaacactcccaactgtccgaatccaacaacccacattgcaatcaaagtcctcaaaagagacagtttcgatggtttaaacttggcacctttaacgtggccgccaataacgctgtgactccaccaaaatatacaaatttcggtgcgtctttaccagaaaacagccctacacgtaactcagaaaggtttcaaaccaagtcatcgtttgggaggggaggttgttaatttcccaccaatccaatcctttaaataccccttaaaactcctattacaagcaaccacatttctctgtacattctttagaagtatagtactagtccaatggcaaagctcattatcttcttcctattgaaactatttctcctctgctccctgccaagatcaaatgcagtctacaacgtactcaattttggagccaaagctgatggtaagacggactcggcccaaccactcctcaaagcttgggcggcggcgtgccgatcatcttccccggcgacaatccatgtgcctgcagggagttttctactaagccaagccatcttcaatggtccatgcaagaacacggcgatcaagttttcgatcgatgggacgatcatctcaccttcatattatggcaagtcaggtgcttctaaggaatggattgcgtttaacaatgtcgaaggcgtgacgattcgcggcggtaacctcgatggaagaggtggagctctgtggacctgcaaatttgatggccggagctgcccaaccggtgcaactgtaagtaaataagcataacatacctttgagaataatcatgtcatagttgcacgtattaattcagcatagatcactaaaactactttgcttaaatcaagcaacaatactagcatgtgcatgtcaccatgttgctagatggctagttagtagtgtttgatcaatagtatcatggccatttaagtgaattaaggcatttgctctgaaattgatttgtgttttccgatgaatttgcagtcactgaccttcagcaactcgaagaacatcatgatcgatggcgtaacatcgatcaacagcgagctgttccacattgccatcgtcggctgccaaggagtgaggattcaaggtgtttacatcctggcttcagggaacagccctaatactgatggcattcatgttcagatgtccaccggcgtcagcatagttcgggccaacatcaagaccggcgatgactgcatctccatcggaccgggcacctcgcacctttggattgagcgtgtgttctgtggaccagggcatggcatcaggtgaacatcttaagggaaaaaaattaatcaaggctaggtacatcttagtttggcccaaaaccaagcactattttgaccaaactaaggagcaaatgagtcagtatggctctaaaatttgcacataaagcaacatggatgaggcatgtgtcagctgaaatgcatcatttcttaattcttctagccctctatttgatgttcatatagatattttatttatgtacatgaggggctctagacttagacatgcatggaaacaaagttggtctacatgtggcctgcattctagacttatgcatacatgtagacaaattgacctaaatgcgaaataagtcattgccttatgtttttcatgaaccaaatgaagcacagaacactttcatttctaaaggattcttgaatttaagccaactcctcatgaaaggaacaagcattgaccaagtattctttatgtggaacacatcacacatatttttgaactttttcaaatcaacattgatgctgtgcccccattaggatttgaactatacacctctctgagtctgagaatgaacatttaggagaggtatgccaatagttgaacccaggtcatgttgaatagtcttgactagttgtgcactatacactgtattcaggtgttttccatgatataaatttagctaaatgtttttttttttttttttattaatttctatcttcaataaattgggtttaattcatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataaatttagctaaattgttttttttttttttattaatttcatcttcaataaattgggtttaatcatcccggattttggatgtgtttgttttgtatcagcattgggagcttaggcaagtcgggggatggactccaggtgaagggtgtacaaaatgtgactgctaaatctgtcatgtttgcgaacactcaaaacgggttcaggattaagacttggggaacaaatgctcgtggttacgttaaaggagttgcttttgtgaacgcactgatgagaaatgtccaaaaccctatcatcatcgatcagaactattgccctggaaaccaaaattgcccgggacaggtatatattgcttcaaattttaactgcagtaaatgcataaatagctttgatagcaattggcaatgaagtttttccttttttctttatatatctaattactaaccagttgcaaataatctttttctttttctttctttttttttgcagaattcgggcattgagatcagccatgtcaactacaaaaatattcgagggacatccgcaacagaagtcgctgtgaatttcgactgtagtccaagcaatccatgcaataaaattagattgaaagatattaagctcacctatcaaaatcggcgggcatggtcttcttgcaaacatgcttatggaattgccactggttctgttatcccaacaagttgtctttgatgcatatgccactggcattatgctattagtgtagggtagggtattgggtagtatgtgcattggcctgctcaagccgacactcgaatgcccttgtttcatgtatttttgcttgtgcacttatcttactccatggagaaaactaatttgttctttttttgaggttttcatattcacatctatgtttcttgttcccttatttcatttttctttttttttttcaagcatggtaccatgaatttccaaacggcaacaaaaatccccagcttgagggtagccttgttgaattgttgttcatttctaattcattgatactcgataagacctcgattctattagcagacatgtatagaaatacatggaaactgcaggggtaatacagctttcactgattaaatcaatgaagaaaaaatggaatttaacaatcacatggacaatggttcttaaattgaagttggaacttggttgcagcccaaagttcactcaagaaactattgtggaacttgatctctgtcatgtttagtctagttatacgatcagttcatttgaacatttttgtaacatggactaacactaaaatcaccttgaacctttcttttctttgtcttttgattattctaaatgactctcaacagtcaactaactacatccttggcaggccattactcgtttcttacctgaacttgcttggtagttgaatcctctgtttctaggtcttctattgttgctgtagagctctaattcaatcactctccttatgtgtttcttgggggtgatttcagctagatcttcccagttcatgcacaaaagcatattatttgtaagtgatatttctcatgctcataatatatggtcggataacatctttgttttttgacttttgtttttggacgagaaacattttctttgctttgaattgcgaatagattgttccctataaaatcaatattaggacagtggaagagatcaaacattctactccatttttcaaaaagcttactcttccatttcttgataattataatatttgcccctaacctttatttgttaatagagggtcagtattaggcatcaaaacgatagaaccatcatagcaaaatccttatttttgtggtggtgatgacctctcaggatgcgtttcaagagaacataccaaagaacatcttaccaatttgatgatacgttgaaaaaagattctattatttctctctccctatcagccatttactgccacaacgagagagtaccaagcttttatgtgatcgttaggttgtggttttttgcctttattttctctgtacattttgaggatgagatttcttgaaaatctagaatggtgagctataagaattgaaaaaccaaatttatagagagagaataaaattggaagcatctaatttgagatctatcttttataattttagttttaaatatctatttttactaatcatatctacttttaaaaaagttatgatctcttccaaccagaaaaaaaaaaaatctgatataaactttatattaatagacataattaatataaatatagatatagaaatcgatgaagaaatctagaaccttaattttgctgtttttcttattcttttcattcttttaagaggtttgtgttgagtgagatgaaaaaaatctgcctcttttttttttatcaaatcatattatggtattctatgaattctttacccatgcatatatcttgaaaaatgactttgctctaggatttttatcttggtcaaacatgttagtatgtagtgctatcaagcgtcacttgatacaatatttgcataaatcttggcttcttatcttagttgatgtaaagcaatcaattaaacccaagatatttgctaatagaatgtattcacaccactcaatattctccagccacctttttctttcttaaatatctttttaatcaacaaatatccaaaaacaattgccagatacaattcttaattcttgatttatcatatcaacgaagatttcaacatcttagtacggaaatattggccaaaatctcaagaaaatgttaattttattattttatttatttgttatattgagatgctttcatctccgcctggacggctcgccggtggagagttggaagcccagctccgctgcacctggcccgaccgtttcaccaccacccaaatctctctctgtctctctttctctcaggggaatggaaatggcggaaggggaggaagtgaggaacaagcaggtggtcttgaagggattcatcgtgggagctccgaaggagacggacatggagttgagggaggggacggccatgctgcgggctcccaaggggtcgggtgccatcctcgtgaagaacctctacctctcctgcgacccctacatgagagggaggatgagggagaactacgattcctacatccctcccttccaacccggctccgtacacccttctttctccttcttccccttcttcttcttcttcttcttcttcttaacttttcttagattttgctacttgtattcctgaaaaggtgatagagggctttggtgtatccaaagttgtggattccgacaatccaagtttcggtgtgggcgacttggtctcagggctaactggttgggaagagtatagtttaatttcgaagactgagcggctgaggaagattcagatcaacgatatccctctctcctatcatctcggtcttcttggtaggtcctttctcttattattgttgtggaaatcctgtcgagtttaagtttttgttactagatgtaccagcaaatttaaagacaattgtgcaacaatattgcaagctggaactattagcatcatgttttatcttttcggatttattcttgcaaagaaaagttgcatattattgcatattcaatatagtacgttatgaaagattgtagacaagtagtttccacataaatctacacgccacctcgtggtaaatgatgctttgctgcattgtcatgccattattgcttagcttcaatgttatttaaatggaggatcagtgtgcaagtaaaagaagctaattactgaggtgttgcaatcttttttatggaaaatgtgtgcctttgaacaaatatatgtgattttattgtttataatatagaggaaaaattatcaagtttcttgtaagttaagggatgctttctggcaatcccacagattttgtctgcctattctatttttgcatttgctcatttagcttttatatatgaatgggtcaatattgggaaacacggtcttttatcttcgatactcaaaaattatgaaccagcttattaacagggtatatgttctgtgttttatatctttcgatcgttttgtcggatctattgcatatgctattgaacaatgtagcctgaatcagttttttggcacaggtatgccaggttttacagcgtatgctggattctatgagatctgttctccaaagaacggagagtatgtctttgtgtctgctgcatcaggagcagtaggccagctagttggtcagcttgcaaagctacatggctgttatgttgttggaagtgcaggcacaaggcaaaaggtaggctcttgctgaatcattgatttcatatatatacatacatacatatatgtgtgtgtgtgcgcgcgcgcgcatgcgtgcttgggattagttgttttaattgagataactgaaatggcaaatcaggttgatcttctgaaggacaaactaggatttgatgaagctttcaattacaaagaggaatctgacttaaacatggctctgaaaaggtcagttcacaaagacagcatggaatgaactactgaggatcttaatttttctagtcgtggcttagtttattgcatctagtctatattagaaatgtgagcaaggttcctgcatcatatataaactatttatccattaataaaaaatttttgatatatgctttctacttgattatataagttatgacctaagtctataagtgacatcttagctggttgtttcaatttacttcatctttaaatttattattgtgcatttctgcctatcaaccctctcttcttgtagggttcttagaaagctattttagtgttagtatggtccaacttcaatacatggcatttttttttccttttctttgttcccttctctttttttctttttttttctttttttttttgaggctgttgagtttgaggaatcaccagttttatcaaaaactttttatgtaaaacctcatatttataagcatagatattgagaatggtatagtaggtgtaggagcagaggaggaaattgtgttattcattgagatgagatgtgatgtggatatcaaggatttggtttctaatagagtggggattcacatcataaaagacctgtttcaagagaatcactagctcctgggaacctcattaaacccatgttttagattttatgggacgcttaaattacctataacccaattggtaacttgcaagcacatgggttaactaaccctaccaaaaccaggtttcatcaaaatcttgttttagtggaacctagtaatcaaacaaaccattactgtatcatattattctcattaggcttgaagctcagaagtcactagtgttaaatagtcccatggtcactggcccactatacgtgtctatgttctattttgttgatatctggtacacagccttagcttatgaatatctctccctcctgtgatgctgtttctgattgcctcctataatgggtattgttgcattatttactctatcttcaggcacttctccagtgaaataatatatggcatcatcttgatggctgagattgcttcttcagacaagtttgtgtgtttgttttgttttttttttaaacagatgaaagaaggggaatggttttgccacaccaaatagccttttgtttagaggatctttcaggcttggccccatggccaagaactaattagcgagcccaaaggcaaagagcacatgtcataatggtccatagacccttgtatcatggtagttggcaaaatatgacccaaacctgctaagctatacaaaaatccacctgaaataaatgggtttggcgttcgggctggtcatttttaaattcagataaaaaatggtcaacatggaaccaacctatttatttactcccgaacctggtgggttgcccgagtcgaatcggctggaaattattggttcccaaacccatggaccatgttgatctcgctgttctatttgttgcattttgctcaattcttggttagttagtttttgatgtgatatattctaagtttttaaattttttgtgcttatgatgataagttgcaagtttaatatgatttttttgtttgtgatctttgccatgctatagcttaccttattttttagttatatatttaattggcaagtgcaaatttatattcgttgatggatgggcccttgtttatttaaaataaatgggtcgggcatgggttgaaaatctttttgacccaaatccactttgactcaacccaaccccaccaatttccagccccataccatggtcatggtactagaccttaacaccaagacaccataggactccattaaagaaaaagggagcagaagtcagactcttgaccactgaaagggtagagattgatttgtaagaggaatctgaaaaaatgcacatcctccttggtcatctctctccagttccatatgcaataagctcaatctagtttggcgaaaaatgcttcatttggtataaaatttcaaactcgcctaggtctgcacggctgcaccaagaatcgggaagcttcctgtgtaaatgaactctgcaaatgtttgtgcagggagcacgctatcctgttttgatcctatcaaaggttgatatactaacacaaggaagacagaggataactttcattatgaagtattttaagagaaaacatccttcaaatcgactgatatggtcttgattataattttgttgtcattttatcttgatagaaatgatcatattctgaaactcctgtaatgagcttatttaactatttatggatttcagtcgagctgtaaataataaatgacttgcccagacgatttttttttctaaaaaacaatccaaatataaagctttatatcaaattgtttagatcatatatctgaatacaaatagctgataatatgtgatttttgtacattggttgtggtgtatattgcaacatctcattttcgttaatttaatgatccttgaaggtctgcttgggtttgatatcaggtcacataaatttgctctatcactccatggagacttctctacttcaagtcatgcattctggtcaatcccctctggcaataaagagatttttttgttgatataatttcaatgaaacacataatttaatttagacaactgtgaacttttaagattaagtttttatttgctaatttccggtccaaacttgactgtctctgttcagacttttttttttttagagtgctgttcgaacatgtttgactcagttatgtacagtgtttgcaaaattgatggaatcttcaatttctttttctttttctttttattatagattggttgacaattttgtctatcaaataggttagatcataaagaaaataaaatctccatgctgaactgaaatttctcatcatcatgtgtcatattgctttctaaaggtttcagctttattatgtgatgcctggactcttgaatttctcatttgtcatgccttgtactggtcctcagcaccttcatcttttataacctgtgaaccttaggtattttcccgagggcatcgatatctactttgataacgtcggtggcccgatgcttgatgcagtgcttctcaacatgagactacatggtcgaattgctgtatgtggaatggtctctcagagtggagtctctgttcctcagggaatctgtaacctgttgtgtcttgtaacaaagagagtaaggatgcagggtttccttcagcacgaccatctgcacttgtttcctcagttcttggatcatatggttagttattacaagcaagggaaggttgtttacatagaagacatgagtgaaggacttgagagtgctccaaattcatttgttggcctattcactggtaaaaatgtaggcaagcaggtagtatgtgtttccgaagagtaattttcttttacatgcttggccttttatgttgttcttgtatgcactgtataacttcattctaataaatttcccaaattctcttgttcatttcttatcgtgtactgaaatgtttgtgaaacataaggagaagcatatgctgtttattagctggggtggcaatggttgaccgtttaatctgtttagattgattcaatccattatagatcaacttagtttatctgtttaataaaatggtcagatttaggtctagattttggatacatttaataaacattttgggttcaggttgatagatttttttttatctatattgtattcgatcccatctaattgccactcatatttattaggctttgaagcgtagtatatgagtaaaggacgggatgtatattcctcacaagtagtttattggaatacaatgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgaatgaaaacacagcagcaaacttaattagtacatatatatttgatattacaaaaataaccttctttattttcatttttgaaggattttttttttggcaaaagtgtcttttaagttgctaaaaccaaaaagaaaacaattctctttagactcttttggactactaaccccaagtctttaaaatgaatatcgttaagtttgactaatatatagatattggtgttggaggagagactcgaatggttttcttgtagatagtttaaatctaagtcggttgtgcaagtggagtgtgaatgcacggaaaaagtggagactaacttcttctaacctataaaaaggataatgataggatactattcttgtaggatcaaattcaaattgagtcatttttgttggttaaaaaaaaatatattttttatgaatttgataattgagttattttcttgtaaaattattataaaatatttcaatatgatgcaaaataatttttttttaataaattaaaaataaaatcaagactgcaaagaaaaatactttgtgtatcttaggggtgcctcaatatgcacctaaatttttgtgaaatatcaaaaataaaataaatagaaaccagatttgatacttgctagaatttatgtttgatatatgcttagcaacatctttttcaaatataagagtaaaataaatatttaaagcttcaatatttttatgataattaaaggtttagaagtcaggaagtagcagatattaggtatttgaaagaaaattttcaaaatttctccataaaaaaacagaacatatgatgtaaattttataaaataaaatatatcaaaatatttctatatttgtacatgtgtattgagataacgagaatttggagaggcaaaaagaagnnnnnnnnnnnnnnnnnnnnaacaacatcactaataattcatgaatgcttcaacgattcaaagttcaaacaataacatatgacgttttggaagaatcaaagaaaaataaagtttttattctggtagaaatatcatattttttgtgatttttacttgggggaaaaggggaacaaactgttgttattgggggtggtggctgaatcttccaaatggctccacccatcccccttttttttctctcctgaaattgtttaatttattaattggctgagtgtggaaactccgcaaagcatgacaagtcttccaccctctggtcgttgttgatttccgcgttcccgttccccgcaacttcttctctcgtcccactttctttttttttttaagggtttggattggatttcgtccgtcggactacttgccactcttctacgcgccacggcggtcgctggtgagtgacaagtttcgatttttttgtcattttttcaagaatttaagatgctctttttagtctgtgagttggtcgttagtggaatcttctggctattttgggtcaagctgggatctttcatctttcttcctgggggtatgcttggattttagttatgctgatgaatttggccaatctagtgatggagttttgtggattttagagatctcggtggagttcttcgatatgtttttccaccaattttttggaaaaggcccgacttttcgtttggagggtttgatgggtgaattatagggccaaaagaaattctatttagaatattgactattaagttttcttccattagaatcatagttcagttgtcttcttttttgtatacgtggtttgtcatggatgaaatgttctgatttttgttgctgttgtcgttgttgttgttgttgtttttagtaataactctggacagaatttgccgagtttgatggtggaagtgtaaggtcttctgagcttgattattcaataatatgcgttttttggctcgcaaatggtacttccttatggtggtttgtctgttggagatgatatctttttcttttttcctttcaataattgtgcatacaagttgctgtgatttgatggtggaagtgattggcgttttctgaggttaattctaacctattcgattgatatatttggatctgatgggtttaaagttggatctctagtcattaaggttttgtgggtttaaaaattgcaccttagtgctctagttttttgcttttatcttgctttatgagctctattttctcgtcttcttagttgaacttttagctttctgaatcagtgggtctggatcttgctggaatttggtttgagtttcactgggttggaaggattagatgagagagttctgtagtttgagggtccgggccaaataatctgtctggcgtaaggatcttttgtgctgattacaaaaggaagcagcagttttttttttaaccattggtttttccaagtatgctgtctcctccaatccttttgagttccggtgacaagataacttttctcagattggagcctgttggtcagggttcttgggtcgaatgacttggaaccgaatagtttctgtattctgcgtagtgtacttcttctgttgtgcagactctgcatgtacattgctcgccttttttggattcattcttttccattctgaatgtcagatatcagtgttttttatgatcggtggtgctagagttgaatatgctcattatcaagcatgtttatagttcatctgatgctcaggtaaaagttgaattaggtttcgctgctgcttcttattcttcaagcaaacaactgtgttatcggatatgttttacttgctcgttctacatgtgaagtgtaatccatgaggttgtatatgagtagctaaatacttcctgtctctttaactgttttctctatttttagctgttggactgagttctgtttcttggtagtgacatgttttacaatgtgatccctatttcatgtctttactatgttatggcatgaaaattgaggacatatggctaaagttcttcttttgtcgtctcacctgttgaacttccatatggttatctttactcttcagaacttcctggtctttgaagctcactaggagaaaccttctagataggggaatgaaccctctttagaactttctaggaacttgtacacacacctgcttcctaagcgcttccttcctacaaagtttttaactgtctgctttcctgaacccacatctacctactaatatcttaacattcaaggaggagtacactaaattacttagctgccttttgcttgttgaatttagaattctgtaggtattataatacattttcttatttagcatgataaaatccatttttttgacaaaacttggatcatatttttgtgcaggtacagcaggaacctggagagcaataatgcttgtccattatacagcttagttggttgtctagaatctgcattcagccgatgtgcctagttttttattgcttatgaccatggaaagtatagctatcattattcttcttcagacccttctctggttattgctgggtaatgtatgttatggtactcaaactgatattaaatgcctgagaacattacagcgatcattgaatgaccccaacaacatgctgacatattcgtggaaatttgataacttgactgagggcttcatgtgcaaatttaatggcgtagattgctggcatcctgatgaaagcagggtccttaatctgcgtctctccaacatgggtctgcaagggcaattcccctcaggtcttgagtattgtaccagtttgactggactggatctctcaaacaacaatttttctggaaccattccacctgacatctcgaaaaagctgccttatgtaacttctcttgatctctcctttaacagtttctctggtgaaattccagtgagcctgtcaaactgtacctaccttaatgtcctcaatcttcaacacaaccgactgactggccagatccctgggcaaattggtggtcttgatcgattgacgacattcaatgtggctgacaatttgttgtcaggaccaattccttcatttaagaagtccttccaagctatatactttgcaaacaatcaagggctttgtgggaaacccttggaatattgtaaggggcctccaaagaaaagccatactgcagtcgttgtgggagcagccattggtggcgcactatttaccatcatagtggtgggagttattatattctattgtttgcgtaatgtgcccatcaggaaaaaggaaaaggatgctgatgaaaacaagtgggtgaagagcataaagggagccaaaggcgtcaaggcaagttgactatatttcatgtcctcttaatttaaatctgtaaggacagcttaagtactatagtctttttgccttatttaaggttcatatagacttacaatgaattcttgtatccaggtttctatgttcgagaagtccatttcaaagatgaagttgaatgatctcatgaaagcaaccaatgattttagcaaagagaacatcattggtacagggagaacgggaactatgtacaaggcaatgctttctgatggctcttatcttgctgtcaaaaggctacaggattcccaacattctgaatcacagttcatctcagagatggcaacattaggaaatgtaaggcatcgcaacttggttcctcttctgggcttctgtgttgctaagaaggagaggttgttagtatacaaacacatgcccagggggaccctttatgatcaattacatcaggtggatgacaaggagaaagtactggaatggccactgaggctaaaaatcagtatcggggcagcaaaagggctagcatggcttcaccatagttgcaaccctcgcatccttcatcgtaacataagctccaaatgcatccttctggatgaagattatgaacctaagatatctgactttggacttgcaaggcttatgaatccaattgatacacatcttagcactttcatcaatggtgagtttggtgacttgggttatgtggcccctgaatatacacgcactctggtggcaactccaaagggtgatgtttacagctttggaacagttctacttgagctggttactggggaaagaccaactcaggtgtctaaagctccagaaagcttcaaaggcaacttggtggagtggattacttatctttcaaatggttctcttcttcaggatgccattgataagtccttaataggaaaggataatgacagggagctcctccaggttttgaaggttgcatgttcttgtgttctgtcagctcctaaggagaggccaactatgtttgaagtataccagcttctaagagctatcggggaaagatatcactttactactgatgatgaaataatgctgcaacctcaaagtcttgatgctgattacctggatgaacttattgtggcacagtgagacagttggctgaatccagaagaaaagcaaattatcactagttttatgaattcttgtgctacaacccccttttgcaattcatgagatgcagttttacctgcctctcacatacatagcacatgctcaagtcttgtaattgtttgctgaaaggagcaaagcaacttatatctatttatcatagacagaggtatctatatgtattgcctgctggctgtcttttgtatggcaggtatatatagatctctatgctgcatattttagatgaagttttagtttctaaaataatatataaactatcaattagacagtgattctagtacttgccttttcgtggtgaataataaccttgtgtatatgttgctcttataatttgaaaatattaattgctatattcttccatcctctttatcatatttgttgcatcattgcctactatgtaatttgacaccctaaagaataattgtacattgctgaggaaacattgaaatgaaccactacttctgtttgtccataaaactatatgcacgtggaagtgaaaatgcaatgcaaagagaatggcatgctaattgccttagtaatattagcttttgtgggaaccaaccctccccctcccccccgcctcctcaatttcctgggctgccatttgttttggtgcttttattggcttcaagatctctacgtgctcttgttcctttcataaagttgtacattttcctactggtgcatttcctgagttgtcatttctcttcctaatggtacatttcctgtgttgccatttctcttaatgctctttttcgttgactgaaaaggttcctttcctagtggtacatttctatggtgctgcttctccctgtgcttgcaattcattccttgttgtgtaagtgatcactgatagattttacttgtatgcatatttaaaggtttatgccattttcctgccaaagacatcatatcaccttcaggtctatcttccaatttcaccaagaagcataattaataaaagcatgtttgttctattaaaacgagctccacttgctactgaggtacaggttgattttgtattcaaattggaaatgtttggttttaaatctctagttttttcttctccatctgtgtaaaggaagttgacagttgaaattttacatgaaatgttttgcatggaatattgcagacctgaagtgaaattttacttcttaagaatcataaccatagcaaagatgggaagtcccacctcctgcgccattccttgttttatgttattctttcatgggtccacgtcggttcaatttagttcttctttggtatttgtctgaaacttttctccaattgctttccacctcctctattagaacatgtctcacaaggaattgtaagtggttcgataaccaactttaaaattactgacacataaatgaatgacccttaaagcaggaacaagatagtgctcttaaactttaagggtttgaagcactgttgtttatttgacttgttccaattacataactagttgcctgttatttccttccttttgagtgaatatgaaaagcttgttttagacttggctaaaataatcccaaatagtgattttaaactgtggaagcactgtttttcatttggcttgttacagcaactttactagttgctttttctgtcttctcttttggatgaatatttcatatctcattgaaatttggctaaattaacctcttatgtaacccactcacatgttactatttagaaatggctatttatcgccttgttgctgattttattcatccagatgattgcttatcactgtactcagatagattatgtttggtgtttggctgctggaagtttctctaatcttttaacatcagttttgatttctatgtagataaagaacaattgacactttgattgcagtactttccactttctttggtaacatttaactttgaaattgcctgacatgatctaatctgtcacagttagagcttgatatccagcagtaaaatgtggggaactttgcagatgctatttgaaatattaatatattataaaatgagatttactctgttgtgcatcttgggatctgcagtcagggtgtagacaaagcactcttatggcatagttagttttgttccaaatttttttttaaaaaaaaattatctgtttctctttttccccttcttttagtagtccatatgaaaactggtttccagtgtctcaaaggaaaatgctaaaacaagtttgggtggatttgttctcccttcgttccagaaatgaagtgctagaatgataccaactccagcaaatcactacaatgaccaactcaaacaaataactacaagagttatgcaccttagcaaccaaaggctgaaatctttgaaaatatttaaaaaaaaaagaactcaaaatctaaaagaagcagtaaagcattctttctttttttttttttttgttcatctggttgtataggtcttgtagtggctattacatgatccagcagtatatattacaaaaaaagataaatcatttttttataggaaatatacaacctgaatcctgcacgttgactacttaatcatgaagcagggcatcatcccatccgatggtaatgtgcaagtcatcatcctcaaattgtagtgggtcgttaagcttaaattatcttttttcttttttttttaacggggggtacatagcttaaattacctattggtaaattcgtttgcctctgatgggtgagagagagagagagagagagaggaacggtcatgaactaaaagtaggagatttatacaaacaataacgaaaaaaaggaacaaaaaattataaaaatatctcttcaattttagtctaattttatttatatctatgtactttaaaaagtgtcaaattagttcttctagttatcaatatattctaatatggttcagtcgtctatcttcattaacagaattttataaaatgatgaaaatattcttatttttatctcttccctccttcctctttcttcctctctgattgatcctctcctctatctctggaatcttctttctccctcatcctcttcttcctcgtcactcatttctccttctccacgatggcttcctccatcttcctcatcttctttctctccatcctcttctccttcttgttctcctccttcgatccatttcttatggccgacaattcctctccctttccctttttatccacttttttgctcatcctcttccttctcattatcctcttcttcctccaaactcacccatgacctcatcgttctataacgaccctcttgacatccaccctttttcaccggcaacccattcttcctcctcctcacccatatctcctcctccatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcatgacagctttaaaagtcataatagcttcattttagaatgcaccacccacatagtgtctggataatgccagcagaatttcctttatggtgttcatgctacacaatctgccctttacagacctaaaattagctctagtttctgtaatcattttcactctgaagcttttacattttcagaacgcccattttgtgcaggaatgctttcaaagatgagttgactctactggaaaaggtgaggcatcctaatgtagttcagtttgtgggagctgttacccaaaatatacccatgatgattgtctcagagtaccatccgagagtatgtttcaatttttctccttccaaattgtaatatggaactcagcaatgtatttattccttaaggctcttggtcattatgactttgttttggactatccaaagtctaatattgttgtatcctgcatatagttctgaatgctgaactttttatgatgtgaatgagctgttgttctgtttcacaccttaagcttttcaacactcagaattaatgttattgacctatctgtttttcttaaatgttattagttaagatggtttttattaagattatgaaattatgacactgtaaattttgctgctgtctgaactcagggtgatctgagaagctatcttcaaaagaaaggacgtttgcagcctcataaagttgtcagatttgcccttgatattgccaggcatgtcattgtatacttttaaattactgtactgaaaactaagttgatgctaagctgccaggatctttttctgtgtatggttggtttccgtttaaaaaattttgcttcgattctattcatctatttgacaagaattaatgttgagaaaagttctttgcttttccacaacactgattccctcttacaccattaaacttcaagttttgctcaacatatgaagtataaattccatatgattgatacttcaccaaattgagttggctgtcctggttgggatgtgggtacatgacaatgttcaaaatcacttaacttgagctaccaatgatttccaatcatttctatgccactatatgcctgttgcattcacattttggtatttcattcacattggaagttcaaggtacaagctctggtgtatgggcacatcatatttagtgtagcaatcacctcaagcgagatgatgaggaaggatggctgacaccttgtcagagaaagaacctgtcttattgttgtgagaaagaggcaagggttaaatgaggcatcccctgtaacaaattagccattacttgatggtgttgaacaaaattatgataatcatctagggctagggtatccaaaatctcctaagaaattgtagtaaggcttgacagttatggctagcatcaatcgttagtactacaacctgtatatctaaatatatatacatgcctctactttcaaattttcaataatttgaggatccttctaaaatattgtttgttcttttgtattcaggggcatgaattatcttcatcagtgcaaaccagatccaataattcattgtgatttaaagccaaagtaagatgaccagatgaatagctcatcctaatataaaaattgaagcttatttatactcaatggattatggattgtactttactatttgaaattttggtaaggtgccagaaatatcttgctggatagtgggggccaattgaaggtggcaggctttggtttgatcaagctatcaaaaatttgccctgataaagcaaaattggctcatccaacagaaattgacatttcaagtaagtcccatcatttgtgatccaaaattaccaaattgtatattaaactataatttttcttttcaaaagtacaaattatttgttatgtaatattaaactaataatgatgactagaagagtagtctctgtaaattgccaacctatgtttctctaaggtactaattgtttcaaaaatcccatctaacatcatctctcaggcttttcctgttacaatgtgcagcaactaactttttctttttaactgtcccatgactcttaaacattgtatccaaaataacccccaaaagattgaaattgatatggaaatacattccatcctgtgattaatggattccaaaatcctagatcatctagaactgtctaccttagtatacatgtttatgaggttactattaggttagaattcttaactatactcaaggtttttcagattttcattttgttttcattagctcagtgaaactcaattagtgagggtcattctttttggaatggcaccccacctgtctttgcacatctcaatttttaatagtaacctccctatcatatcgtcttctcactaaataaatgtgcattttatcctgatggtattatagacatggtttgaattatctactaaagcttatagtgtaatttgattgtattatactacatactttgactctcaattcagtattgatcattctttcttcattctagatttatacatggcaccggaggtctacaaagatgaaatatttgacagaagtgtggatgtgtactcttttggtctcattgtttatgaggtttgtcagaatttttctggtttcagttaatattccagcatttccctccttgcagcagcatccatgcatatagctttcttcattaaagtgagtatataccttatgatatatgtatcagtaatgtgaaaacttaatattaaacagaaacaagtcaattaagttatgtacgagaatcagtacctgaattaaacttcctttcctgcataataaattgtgttgctggctgtgattgacatataatcagtcctttttggtctcttttgaaaagctaactggatttttttttcaagtcagaatgattgtgaagagtttctaaatttttccaccaaatcatttgcttttgtcacattagaccatactctgtgggcatcacaaaaagaagagaaataacttaaagatgaaatctgaagtcagattaaatagactgcatgcgttccctattgcttcttacctttttggctctttccccttactctctctttaagctgaaggtctggtcaagaattattcccctttagtaacttgaatatctatagcatttttctctacaaggcaaattgtgatcccttcataaacaacaggaaatgtagatatgaacatagtgttctaatgtctatcaccaacaagattttgttgtttctctctacctgaatctttgtcatctgaaccgaggcttcttcctagtgtatatttgtttccaccacttctttcttccttttacctccatttagattctctttcagtctctattgatccacatgaaaatatttccttggcctgagagagacggatgatgactctcatttcttgcatgtcatctaacttctacacatcaatgctctttcgaaatgttcttcttgctgcaaaaaatttggtttcttagtctgtttttcaggggcttgcacaatttctgatgctagtgtgtgaaaaagaactccacagtataattcatattctcaaccatcaaacagtaaaatcatggttttcaccttcatattctttcgagtagcatgtttctttgcatcgattacctttatattcttttgagttgcctcctcctttgcattgatcaagcaagcaactcacctatttgggtatgtataaagcttgttagtaactttgataagctagcatgaattgtttcatatccttgatgtaaagatggattgcaatacaattttagagttatctctcttgctttctaagctgctcattagatatagggttctcatgtttgctatcagaatcttttcctgcagggctgttattgggctaaatatgatcatctatgatgatgatgaaaaacaaaaagcatattcgtgtcacttggatgccatcagttataaacaaggacattgttgtttctacaagatactgcacttgtatgatttgaatgatgtttaataaatttatgtttgaaataggtgctagtttacatttttttattgtttagctgttgcttgaagttcataatcatgcttttgggccattttcttttacatattggatttgattactaggataatgccgaccttcttttccgactgatatagtcctattcatagtttatgaatgaagttaattcatgtaaaacagctcagcaagttattcgttgctttaatgtatagcactacagcttaagcaaatatcatagggagtgagaaatctcgtttcccatgttttctcggaatggtgcttaggatgaattgatgaattggggtactaaattaaatttaaacattaacctttatctagaattattcaagtgaataaagatttccttagaccttgttttggtaaattttcttatggccttgaaattatgttttctatgatatgtccgtcatagtaaagctccaaggaatgctctaacattagcacatattgcaaaagccagatgtattgcatgggtccattttgatctcctgacaatgctttctttgaagcttgtcatgttggagttggatgtgaataaattaagattttctacaagtaaatgagatagaatgtagtggttggatttgtgattagtatggatatcttcaggaaaggaattggcttgatcagtgccctttgtatagagaatagaaggaaaacttgttcttcttgttacatttacattcttcatgtttaagaaagacctattagtaattgtctcgcatcatgtttaagagagcataggaagtatttacagtatacttgttatccatcatatatattttgcagattatcttaaaattgtctcttatgaagcagaatataagctttttttaatctactcttatgtttgttttgcatgttcaattggtttcagatgattgaaggagcaccagccttccacccgaaggccccggaggaggcggctaaaatactttgtttagaaggaaagagaccatcattaaagaacaaagcaaaaaagttatccttcagattttaaggagtaagtttgtaaattttatgagtcttaacttaaagttgttaatttttcttcatgcacggaacaaaatttttttttttggcaaaaagaattaccatgtgggaaacaatttaacattagttattatgcaatatcatagaggtttatttcaattgctgtatattgcatttacttacattaatttatcatttattggatcttaaggttgtcatctcttgaactaagaatactcaatcttgcaatataattggacctcctatcttatcatttatgcatgcttgaccaatacattctccagctacacaaataggaatccattattagctgagtcttacacatgtgagctaagtcttaggctttcccagaaccacttaacaacttcatctggtaggcagtcttttctacttgaccatctcttatccagagtctctagacattatgcatgcaatggatgtggcaaggcaatttgtcttgttctgcactttctggaaactttcctgctttggaacatatgttggttcaggccttggtcaactctgagcataaacaaatagattcagacaaattacagcataataacatgcttacgtatgtactttccttatgattgaaacaatgtactaactggtggcatatgcatagcatatgtggcatttatagaccaataattattattagggttttcctatctttctctctgcattatcctagttatcttagaactaggctgttcctcagttcagctttagtggccggccttgtctagagttgtagacagcacagggcgctacctgctcggttgagcttcaccaccctacacatatccaatacaggataattagaaataattagaaagcaacttgacatataggcttccatctttcttatttcttttctttggcctgtgggtgttgctgaagctcgctacacagaaaagctccttattgatacacaagtggtagtccatttatgaactcataacatgcctttatgccttggaatgttcaacagatgcttctgacaatgttgtatcatgcttactttcacaggtgcaaatttggttttccattgttattgcatttacttggatttatttttttcttcttgctacaattgcatttgctatgtaaccaaggcgagcttcatcaagctgtgatttgatccatctaaacttgaaactaattttgagcttgaaatccaagatcaagcttgacttgtttatcatttgatagcaggagcctagttatgtgcaaaactgaacataatcctgttttgattggccttggcaactatgaagccaaaattggtctagcttgtataaatcttgaattatatgcctgatcatttattctgactacaaataggtaggcaggtggaatttgactttctcatcctaagaacccaaaaatcagccattgaatctatttcagtggttgattatatgttcttatatgcatgttatgttatatgcccagtcagcacttatcgatccatgccttattgagccaaccttttctctgtattggcttgaaattaatttcaaccatgagaaccaaccaggttcaagatcagcctcattaacttccaaccaagcttgattaatcttatatttcagttgatctcaacccattctcaagaagctctgattaattgaaagccctgagtacatgatagcatctgaacgagtgcactatgtctgcctgtcttcttttcccaagacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggtagcaaaatataactgttggcatggaatgatgaattacaaattgggttttaaagtgccatggaattctttgcaattacaattgcaggatatctctgttagccacatgttcatgtttgttattagttataatacttttgatggttgaccacaatgatttgggatctgaaccaagtataaaggtagtttaggtatgacaatgttccagaatgtattggttagatgagtttatctcgcaacaaaaaaaatatgaactattatgtcccaaaaaaagtttttttaaaaaaagaagctcaacaatctttggtccatcaactcagtccatccttttttttttccattacaattcagactgttctattttgcaatttacaccacatctatgtgcataccctcaggaaaataaatgaatattttttttgaatatgttgcacatcacttttttatgttgtaacatattactttggacatctattcagagagtgtacttatatatccttctattttaatatatggttggaatacatatgcatcaattttttggtgtctatagtttgatatgtatcttaaagaaaagaaggaaaaagaaggctgacatattttccactttcatcatatacatattttcccttcattttcacaaactgatttgttgtttagacttatgatacaaatacatgtgccaccatcgacattcatttttttcttacagtatgttgaaaatgcctacatgaaatactccatgtgcaggttgattgaagaatgctgggattctaatactgcagtgaggcccacattttttgagataattgttcgattggacaaaacatatgccacttgtgccaaacagggatggtggaaagacacatttaagcttccttggtatgcacatatttaccctattatccacgagcaactttgtgagtgtcaagtcattagcattctttcatgtgtgaaatgaaaggcattcttaagatagaatatttatctgcagccaatgagatttattttgattcattttaagaatccgatcatgattagattttctgtgaacaagcatcgacatggttttgaagacactttcgagcaaactacttggcctataaatggaatttattggtgtaggatccattaagctgtcttcaaaacaatgaatgtcttttttaggtctacatttggtagttgagatgtgaaatcaactaatcatgtcaggccatcttgttgaattatatgttatggccagatgtgtaaccataccagtctgtttagtgcatctgaaagataaagataaaaagttcagtcagaaaagaacattgtctaaagtaattacaacgtccatgttttattgactggattctaaaattggcggcagtgatcgatcccccataactgtcagagaacgtaattgctccttaacttctgatcattttgccaaattataaccatctggtgctactacggataaactattttactttttaatgctggcaaagttttggtctttttcacacctacttttgtttgaccaattgatctaactcttatctaatttatgaatcatatgtatcacatcttgttgtcattttttatatagtgtagctgtctggttatttattttgttactacactgcatcagaaaattctctttgtagcttagtatcaataccttcaagatttattttgaaatggctaaagctccctattcttttcatattgctgcaaaagttacaagttctgtccataattgtagtatcacaaatgtttttgaaataatgttggtgaattatttattttgttaatgtacattattggtacttaatgcagtcataaagtagcattcttgctatcacattcccctagcaattccttttttcctttttcttttgctaattaagaagacatccttaagcaattctaactttgccattatctattaaaccataaactgtctatctgaatactgtgagaagtgcttgaattttccttttgttttctaataaataggtttgataaaaatctccatccatccactaactctttgtaaattcttatcaagtaaaaagtcctttcctgctaatatgcttcattcatgtgtaagtttcttcttttttatttaacttggaaaatttcatgtgtaaattgggtggatgagtacatattgattctctgttgcatcatacgtgcataatgaacttgtcagtgatcaagggtcaatggcaattttttttagaattgaaacaggttttttttcttttaatctagtacaaaactgcataatgaacttgtcatcaagggtcgatgttgatttgtttttgaatcaaaataggtcttttatctaatacaaaactctccagttctgctatctgtctttctctcttcttctacaaatcttgcattgcttccagatccgtttgattcaagcttatttttccttctccctctctttatagttttttcattttgtttgaacaatttgaattttaagttgttctttcaactaatctcttgtattgctctgggcgacttttctgatgcttttcaggaaatagcgtgaagtgatgggctcattctgtgctacaagatgttgttgtactatatgtaagaataagcttctttcaacaacatatgtttgaaaattatgatgtattcttgttgttaagagactcgaacatttccattatgaatttccaaagtttctaaataaaccatcagtttgtgtttcctagttccttattctatattgcaaaactgtagctaatgatcaaaactcatatgcaggacgctcactctttttggagtctcagatctgccagaccttgcattgtacttgcaccccttttgtaggatactagtgatgcaatatgggcaggtgaacgagatatgaattaggccacaaatagatcgtctacttcagacactggcagggacttaaatgaatgaatctttctgaatagatacaatgaatcaaacattgacagcaggtcagagtagaccgcaccagtattgggttctgagtgggattaagttgaagcaggaaaatgcttgtgaattttgacaccattattggaaaataaattggttttttccttttattttatacgaaagttctcaggcaaatctatttctttttctattcttcttttttttttgtttccttttagattattaaagccctacaagttagacactgttgcacaaagccctgacctgatctttggacattgagactcctatggttagtatgacaaagcctccaaaccatgcatgttgccctagagatgcctccaaatatcaggacaactgttagtgatatttgagagcacatccacaagatatgaacctaaaacatcctctaaatagtttccttctgttgttctctttctcggcttcccattatttgtgtatgtgcacacgtgggaaaaaaagaaaaaaaaggaagtactgcaccatgaattcatggaacaaggccaaactagagcttagcatggaactagattttctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatataatatattatattagtataatataatataattatattattattaaaatattattatgttatattgtattattataatgtaataatattataatagattatattatatgtctataacataaatagtattatgttttaaaatattattttattgtatcatattattatcatatcatataatataatatatactataatataatattattataattatgatgtaatacataatgtaatatattataatggattataatctaatctaataataaattataatataacagatcatattatattattgtaatataataatattatattattaataaatattattatatcaaattatattttaataatataataatactataataaattatattatatatttataatatatcgtaatattaatttattattatattatttatatttataatataataatataatatgatataattatgagatttgttagtgggtatttctgtcattaaaaaaaaattatttaaattaaaacagcttcctgatattagtcagaaagcatttttggaaaaagcttcaaaatacagctttcctcaagtaaaccttttcagctttttggcaaagccaaaatagctttttgattttttaccaaacatcactgtatcatcctaaagtgctttatgagagtcctaaaatattttctgagagtcagaaagtgctttttggcacactaaaagcttagcctaacagggccttagcacggcaaaagctaaagtgaaagctaagaagttggaggaatcctagaggattgtaaaatctatcataaagaagttctgggccaaacttcttggggttggtccttctttgggagctgttgcttctatgagcaggttttaactctatccttttgcctattgtcttctgcatttgagtccattctgaagttctacaatcataatttcttgatttttttaccttttttcttttttcaaggtcggactgggccgtaaagttccaccattggaaggatgaatttgtgtctgttctgcagcattactggctgggtttgaaactactttgggcagatataagaatttcctcgagcttacttttgaagcttgctggtggaaagaacctctcaagaagagaacagcagcagctaactagcaccacagccgatatcttctggctggttccttttgcagtttttattatagttccatttatggagttcttgctgtcagttttcctgaaattatttcccaacatgttgctatctacttttcaggacaagatgaaagaacaggtatgctttcaaaggtttccactgtggtcaggaaattcactttgttatctctattttttcttgagagagagaaagattggacagagtcaactttgttatctacatgttgaactttgatacgtagaggttcttgtttctgccaatccccaaaggtcaatttttcaaatttttgatttgtggaaactgaaactgtgcacagttaaagagatctgcagtatttattgtgataagttggattgtcatctcgctaggtgtgttcataaaagcttatgagcaaattcttgttaacctttttttttccatttatgaagtgtatggcaacctgtaatttgatatattctgttgttatccttcccaaggagaacattcaacctcactactgtctcgtgacaaataacctgtaggaagcttttaaaaaggcatctcaaagcaagaatggagtatgcaaagtttttacaggatacagtgaaagaaacggcaaaagaagtcaaagactcacgaaatggagaaattaaacagactgcagaggatcttgatgaattcttgaacaaggtaatatttttcttgactacattactcttttgcactattatcaatgtgctatttcacttcttctgtttgcttttttagcgtcatgagcatttgaactaaattcttgttaggctagaactggtgcatgggtttccaatgatgaaattttaagttttgcaaagttgtttaatgacgagctgactctggacaatatcagccggtcacggttatgatgctaactatgtgtaagtatacatttcatatgcttatcttgtgttattgcatcactgatttttttttttttttttaaatgtgtgcaggccaagattggttaatatgtgtaagtatatgggaatcccaccatatggaacagataattatttgcggtttatgcttcgaagaaaattattttggtaggttatatgtttttaaagttcaaagaaaatgcatcatcctaacttttattatcaaatttagtggctaatcagtgggagatgatggatattggttgtcttacacaatggcctggggacatctttttttgtattgttggtatatgctatatgggtttccataaacattgggtaccacctcacttaggagtgcacactgagcagggtcagcccatggcttgcccgaccagcatacatcataagaaggttgggccaatatttttatggtatgggttgaactcgagtcacaaagttttggcccaactaaaattaggctaggcttgggccaatgatttatgagcttgatagcccaacctagcctgaggcaatacttctatagcacatatatgtacagttggcatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatattacacaaatataataaaaaatataatattaaaactttaggtaaagatgctagtcatctaaggagtacaaccttgtttgggagagcttttggaaggccagaaagtgctttctggagagtgaaaagcactttcaggagatatggaagtgtttggtaaaatattaagaagtgctttcagatttctaaaaagctggaaagttctacttgggaaagttctattttggagattttctcaagagccctacttgactgatgtttggaagttgtttttgttttttaatgaaaatttcgtagcaacataatgacattatattataataatataataatacattactgtattatattatattatatcatgtcatgttacattatattattatactatgcaatattatattatattacattatcttgtaattatattatattatattatattatgttatgttatattttgttacatcatatcatattgttacattacaatactatataacattataatatatacattatatcacattataataatattatactatgtaatagtatgttactattattatactatagtatattatataatattatattatatatcttattatgtcatattatattgtactattatgctatactatacaataatatattacattatagtatttatcacattatattacattataacaatatcatactttgtaataatattttaatacgtaatattacattattatactagacaatactacaatattacaattacattataatatttatcatattatattatattataataattttatactttataataatattttaatatgtaataatatgtaatattatattattacacaagacaatactatgcaatgtcctttattgtcattttgtcataccaaaagtactttctcaacctttcactctgtgataaaggagatacttctagttaaaaaatccattgtgacattatacttgaatatggtgtggtaagattaggtaaggatagaaaaagttaattatacttaaattgattaagtacaggtatataaatctttagcttcatcaatggtgcaatctgaagttatgttgccaatgttgtttgcatagttaattgccattgcttttgataaaatatgtcgtattatccacttttctctaccacattgtcttcttatttgaaatttgttatggaagatatatttcatgatgtgaaataatgtgcaaaaattgggagattgatattgaatattattctttggaggtctggaagggagtttgaggaaaatattataatagatacttgtggagaaactgcaggccttaaggcccgttagtctcttataaacacaatattatagaaatcaatgttactaagctctccaagttattatatgttgtgatgtttgtttgtgtttcttaagcagacacaagattgctcatgattttgttatgacatgagtgcaaccttttttacacaagtttgtcaagctccgaattgtttattgtaggctttttttagaataaatattacttgtgattcattgtaacatatgaatgtgacctcttttttgcaaaagtttgttaagtttggaattgtttattgcaattttctcaataaatatatttagatgattgtgcctagtgatgatgatctccatgttatattgtgtatgttgatttaatgcttacatggtaataactaaacatattgcttacgtgattcatttattgaagatatacacctacttctaaggatgtcatgttttggtatttttgccacatttagtcaatgttcacaatctcagtaccagacctgtactggtaccatgctgacacaatgttagtatgtccgatacgtggattgattcagtgcaccaagtctttgttcggtatcggtttagtatggtatacctggtatggtgcggtatgtaccagaatggtgaatcttgctagttaatatgacggtgctaggtggtaaaattaggacgatgggtttactatgaggaaatcaggtggtgcaaagtgttatgatcttgtgacagacttgaattttgatagaactaaatggcataagaaatttaaaatatccaaatgaaaacagctgggatttggagtatcagtgatgttaggtttagaaaagagaataggattcctcacccccccccccttctctctcttcctcccctttggaggatgtccctgttcgctgattggcttctgctagaactatttggatattttctttgaagagccatttcattgtaatagggcttgggtttgtttctagttaagaagagagaggtaataagagtggctgcttttgaagattgtaactacatgatttacaatctcggaaccaccctatccccacctccaaaccaccacgatgaccaccatgcaagcacccacacatgcacaagagagagagagtgtgtgtgagaggagatgatgaaagacatttactttcaatttaggatttttcgaagctggaaagaaaaaagctattttatgcatgtgccttaaggcagggagcggggggacctttgacgataacacatacttgcccttaacctatttcctcttgagaagcaactaaccagaattggcagattctgcagcttgaaggacctcggaagataacacatacttcagaagattgaaatgagttaaaccgaaggcttgcctgagaagcaaccgagctctttgaaaattcagaatttctgtgatgatttaggtataagattatctagggaagcctgcacatttactgccatagtatggtgttaaagtggcatagtttgcagaccaccccccttttgcatggaagaatttgtccgggctttatatatatatatataaaatctgaatttgataatgatccacattttgccttttgttccttttcactgcttcttttaattaatttcaactctctttgtctagaattcagtcttttgatttttaaagtttgttggcattaccatggtttagcatcaaagaagcaatgattttttcccattgtttggacaggacaaaaaatgatgatatattgattcaggcagagggtgtagaatctcttttagaatgtgaacttaggcaagcatgtagggaccgaggacacctcggcttgctttcaaccgatgagatgtgccaataggtttacaatcatctttataatgttattggattttgtaaatgatagacccaattaaaaacaagtctcttaaagttttcttatgcctgtactaaggaaattctttgcttatttttctattgcatgcaccattggaaataaagtgcagatgtggaaaatacttagttattaatcattgttctgttttatctgtttacatatcaatttgctcttctacattcttatcgcttatgtatcagattctgatcagctaaccatttccttactgcaattattttctttatacttaatagcatttctagagtctactgtacggatcttaaagttttccaaatttcagcattttactaaaactttgctgagtctgatttgacgtcctcacctaggaaattacatttcacagttctgttattttagtcaaatttgctaatgaaaaactgctaatagttttactctttcaatgtttttatccagcttcgagactggttggatttgtctctcaaccgctcagtgccatcttctctcctgatactttctaggtagtttttcatctagttttttttttttttaaatatatgttgtttcctcctgattaatttggatgtcatttcttagagctttcactgtttctggaaatatgaaacccgaggaggcggttgcagctacactatcttctctacctgatgaggttgtggatactgttggtactggtttgccatctgaagatgctgtttcagagaggaggaggaaattggattaccttgaaatgcaagaagaacttatcaaggtacaatatcatatttattttcttgatgcatcttcctttatcattaccttatttgtttagtatcagtattgggagattaatgtattcaaacaatttattcaatggattagttttcacacttggctgtttggtttatgatttctgccttagagataaacaatgccgtgcccttcttctttttttttttgggggtggtcctcttctggacccttgtcaagtttatcttagaatgctgttcctagttgcataagcttgaaatgtaaaaccaagggattaattgtgaggccctctcctgctcatgtttccttgttaaaatttaagaatttgttagggattgacatcaggttaaccaatggtcttgatgatttgctaaatccttttccagcactactaatgtgcttaatccttgagccaagccttcttgtaatatgctccatttttttggctctagccttggttcatatctattggtctagttaattatgttaaattgtttgctactggttctactggacttctgggctaattggaatttgtcctttatcattagcaagccaatgttgtatgagtgcaattgttaaagcatgtttctatgcatagaatgataaagtttcctgcagaattaattgtgagtagatctgtataatcttgcactctactattttttgcaactgctaaatgatttccattatgtagaagcagacaacataaatcaagacattggaagactagatgatcatacatgttagcaaagaattgaatgattctaatgcaaaacattattagtctcaaagacttaaagtctaaacttcagtggtatatgaaatcatgaggagcaccacccaccagcctgccctgtaaaagggttcctttcttcatgtcctaaagtcttgaagcattgccatgtatctatcagccatctatatatgtgtacagctgtagttgtcatattctatttagctcttattatctttgtagtgtcacgagatgttctcatgctcaatgactagtcctgcacatatgttttttttaaatgcatagttctgcttctgagttcaattttccatcttttttattattggtatgttcaaccattagcatgtggtttcctacatttgattgttttctggcaaaactgtttcataaccgtggcattttcctgtatgagtgagtgtatccagctccagattattaggtcagattgctattaatagttttggtttgtatgcatagttctatttcatttccttctgaggtcgcccaacaaaaaaaaagaggaaatggaatatcaaagccatcatgttatgaattcaaattcactgtggcgcaaatgatagatgatgtgatttcattggcatcatggcatgtatatatctttcatgtatcaaactcgaaaactgtttgcatgtgatttgatattgttcaattatttgcatttaattgctcgtcagctattcaaaagcaaggattatcatcatgccttctacagcagaattctttcgatccttttttgcagtagctgctaatttgtcagacattatttttttccttcttaatgagcacataagtaaaatatgttggctgctatcatgatcctcttttaaaaattttattttactcaactttgcaatcctttgcatctcattgtgcattctgcaaatctttgtttttttggtgcttatgtaggagaaagaaagggatcaaaagaaagaggagaaagctaggatggaatctttgaggaatgatgaggatgtggctttgaaggagttaacaattcctaccgcaaaggaagtagaggagctggcaagaatgaaagcgtgggaaaaaagagaagacctctgtaaaatcagccgtgcattagctgttctagcttcagcatcagtaaggactgatatgaatatcctttcatcaacttttagctgtccctagcatttacaatgattttacaactgcttccaaaactcatatattgcttttccgttaaccttgcagtctgtcagcagggagcgtcaagagttcttgagtcttgttaacaaagaggtatatttcatcttttaggtatgaatattgctactttttgcatctaggcttgaatggctcactttatattgtcaaggtagaccatatgcacttatgaccggaagccttctcttatctctgggaataaaacttgtattctacatttcatactgcagatagaactgtacaacaccatgctcgagggtcttgaatgagaagcagctaagaaagcatatagtgcagtcagggagaatactgaccatgatgctgaagcagctgcagaagataaggtctcatcagcacttataaacaaggtaagatttcttttcacttgcacagcttatctcttcttcactcttctcatagttggaaacatatttaactaaatggtattgacattttctccgcatgcttttcttttttcctatcacaacccttccatatactgagtatgtgcaaatgtgcaccatgttagccttgcaccaatcatctttattgttaatgttcatgcatgaatttctttttcttcctttcatttatagaattgaatgcagtgcaataccaattacaaatcccttgttttcagtatgtttttcttattttctagaacctggttggaatctgtattattgtcactaacgaattaataactgcttctttgaacttcttaaggtggatgtaacagtatcagttataaagtttcttgggagaattcgtttgtaccattttgttttatggaggcaattaagaaactagttgcatacttgcatgatatgttcttaggatatcaaggttctagtattttcttatctggatatttcttccttcgatacttcttttgggggataggggattatataatgccatttttctgcactccaggttgatgcaatgctccaagaacttgaaaaggagattgatgatgtagatgctataattggtaactgctggcagctacttgacaggtaattattctttgctttttgttttccttttttgcatgcgttgtgggttttaagatggaaaaataggcttgtcccttccattttttttaagcagatctgagtggcatgtaatatttacaacattgcaactacggtccctattgccattactaccccatcattcacacctatgtggccatctcttgtcccagtgagcttctataaatcctttattatcttgtgtcctgctattcagttgttccacaacttagtcggcctatctactaaaactttattcgaatttaaaacaactatatttgttgtttttggtgttatatcatgaatattttatgcagattcgctttttccctcagacactctatgctacttcagaccatacatggctgtagaccaagacactttttaattttgcctctttggtttttcttcatattttgttggttgaattgatatccttttggcttcccaggtttggaatgtaactgatgatttctttttttccgtatttgaaatttctcactctatgaagtactctgttgcttatattttagtgatcatgatggcaaagtgacaccagaagaggttgcagctgcagccatgtacttaaaagacaccttagacaaggcggatgtccaggaactcatcagcaacatttctagggatagaggttgattgctgaatacttggcaaattttttcacagttccatttaaattggtttcgcttgtctagcttctgaatttatcataatagcacattgatcatattttcctcttctaatttttattttgacagaagggaaaattcttgttgaagacatagtcaagctaggcagtcaaatagatgatgccaatggagatgaaacagaacttcagtcgttggtaatacaattgcggtttcttatgtaattttcagataaccatttttttattccgggtcaaaattttggtggcctggtcaaaataacctatgtatatatgtggttatataagatagttagtgctcacgtatgttctgtatcaatttatttgtttgcactttttgccctgtccagtttactgacctaaatgtgatctatattgtcaagcttactttggcaacctattgattctttatgcaatggataaaggtcgtatcttttgctgttgttaatgcaaaatgtggtccagtcctcgaagagcttgattcggttctccctcttggagatattatgtagtgaacccatgttcagtttattcatctttttatttttatttttttctaggggccccatatttattgcatgcattgtagctgttagttgttttggctgattagctaacgatatccccacatgggcatcgccttctgaagttttattgtgtcagagtttggattgtggcttcagatcatgtagcagagttctatcaaaagatttgacctgggggttccaccatttgcaaagtgtcaactcttagatcagattcatgcagcattttgttagcgtaattctcggagtgccgtttctgtccaatgtcttttggaagtctggtattttggtatctgatggttcttaactaatgactgaaattgacggagaactataaaattgcagtatttttgtttaacaaaggtataattgattctattgggttttatagtgaatggctgtgtggatctttagtcttttctcctttacgagagttcttctttgaggctttggagatatgccggttcagcatgaccctacatttatttgtgaggcttctcgaatcagtttaggggttttggttctcattattcggtaaccaacccaaagttttctcccactctcattacaaatagaatgagcaaggccacgacggaaagcttcagctctcgccacgccaagaacgagactcgcaggcattaagcttcagttaagcattatagctgtgggctttgacaagcatctcgtaatctcttttccgagagtagtttgtctcttttctgtattcatctttcgaccttgagatttgaaaaccagtccatcttgtggttttgtactccattccaattcaccagtgttaactagcagtgggttggtggattggtcttcttgtgctctccattaagaatttcctctcatccgttcgctttgtagttctttcctgtttgtctccctaggattccaactgaacaggagattcgctctctattaaactggcattcagtcattttcctttgaatgtatcataattatggattgtcgtccctttgattgtcttctttcaagttgacattcttggaacaagactccattttagttactatgacgttgctgagttaggatgtcggaatggttcttctatcattctttggaatgatttatagcgttcctctagttggtctgaaaaaaaaaaaacataatgcaatatgggctgtataacacatattagacgataaaaagaacggctagttggcagcttgcgcggagtctacaaaattgcgcatccaatgtatagctgataaacgagatgtagcttgatctccattccaaaaagacgcgagggttatgtagtatgagctacaaaatgtgcacccgaattttttttttttttttgctctcttaaaaaaagtgcagatggtgaccaatttaccatcagtgtccgaactataacactttcttggcattctttattgacataaattaactagattcctattcaaatgtattcaaggaacaaaaataataggtaattaactgctggtcccttttttgacttcattctaacaaaatatttttgttgaccaaaacttttaactcccgtccattcttttatactacagtaacaaaacatccttttgacgtcatcttattttaaaaaatatcgaactttccctttactttcatcttcctttctcttttttcttcgttcctccctttccttcaacataaaagagaaaatggactccgctgctctcactacaaggcttctcaacttgatctctaaccctagttcttcttctttgttcttctccataaggtgtcggccatgttggaggctgctctccctcaccgtatgctacttccagaccctcaaccttgctcccaccccttccccaagcttggctctcttctcgcctgctctaccatctctacctaggaggccctcgtcaacctccctggcctctgcctctgctgcctcgttgatgagttctggtccatccccgagctgattgatcgctccacgcacaggccgtcaaaagaagcctcctttgtaatgtttttgttcagagatcttttattcgaatgtatgcaaagtgccttgcttgccatgatgctcataaagtgttttgcagaatgcaacatccagatgttgtttctcagaatcatttgaccatcaggtttataaacaacggcgatttggagattgtgcggaaggttttcgatggaatggctaagagatatagtttcttggagcattatggttgatgggtatgcgagatatgggctgaaggagattgctcaggacctctttgatgcaatgcccaagaggaatcagttttcatagaattcattgatatttgggtactcgagatgtggtagcgtggaagttgctaagttaggatgtcggaatggttcttctatcattctttggaatgatttatagcgttcttctagttggtctgaaaaataaaaaaataatgcaatatgagctgtataacacgtattagacgataaaaagaacggctagttggcagcttgcgcggagtctacaaaattgcgcatccaatgtatagctgataaacaagatgtagcttgatctccattctaaaaagacacgagggttatgtagtatgagctacaaaatgtgcacccgaactttttttttttgctctcttaaaaaaagtacagatggtgaccagtttaccatcagtgtccgaactataacactttcttggcattctttattgacataaattaactagattcctattcaaatgtattcgaggaacaaaaataataggtaattaactgctggtcccttttttgacttcattctaacaaaatatttttgttgaccaaaatttttaactcccgtccattcgtttatactacagtaataaaatatccttttgacgtcatcttattttaaaaaatatcgaacttaccctttactttcatcttcctttcttttttcttcgttcctccctttccttcaacataaaagagaaaatggactccgctgctctcactacaaagcttctcaacttgatctctaaccctagttcttcttctttgttctttttcataaggtgtcggccatgttggaggctgctctccctcaccgtatgctacttccagaccctccaccttgctcccaccccttccccaagcttggctctcttctcgcctgctctaccatctctacctaggaggccttcgtcaacctccctggcctctgcttctgctgcctcgttgatgagttctggtccattcccaagctgattgatcgctccacgcacaggccatcaaaagaggcctcctttgtaatgtttttgttcagagatctcttgttcgaatgtatgcaaagtgccttgcttgccatgatgctcataaagtgttttgcagaatgcaacatctagatgttgtttctcagaatcatttgatcatcaggtttataaacaacggcgatttggagactgtgcggaaggttttcgatggaatggataagagatatggttttttggagcattatggttgatgggtatgcgagatatgggctgaaggagattgctcaggacctctttgatgcaatgcccaagaggaatcagttttcatagaattcattgatatttgggtactcgagatgtggtagcgtggaagttgctaagttaggatgtcagaatggttcttctatcattctttggaatgatttatagcattcctctagttggtctgaaaaataaaaatataatacaatatgagctgtataacacgtattagacgataaaaagaacggctagttggcagcttgcacggagtctacaaaattgcgcatccaatgtatagctgataaacgagatgcagcttaatctccattctaaaaagacgcgagggttatgtagtatgagctacaaaatgtgcacctgaatgtttttttttttttgctctcttaaaaaaagtgcagatggtgaccaatttgccatcagtgtctgaaccataacactttcttggcattctttattgacataaattaactagattcctattcaaatgtattcgaggaacaaaaataataggtaattaacttctggtcccttttttgacttcattctaacaaaatatttttgttgaccaaaacttttaactcccgtccattcttttatactacagtaacaaaacatctttttgacgtcatcttattttaaaaaatatcgaacttaccctttactttcatcttcctttctttttccttcgttcctccctttccttctacataaaagagaaaatggactccgctgctctcactacaagacttctcaacttgatccctaaccttagttcttcttctttgttcttctccacaaggtgtcggttatgttggaggctgctctccctcaccgtatgctacttccagacccccaaccttgcttccaccccttcctcaagcttggctctcttctcgcctgctctaccatctctacctaggaggccctcgtcaacctccctggcctctgcctctgctgcctcgttgatgagttctggtccatccccgagctgattgatcgctccacgcacaggccgtcaaaagaggtctcctttgtgatgtttttgttcagagatctcttattcgaatgtatgcaaagtgccttgcttgccatgatgctcataaagtgttttgtagaatgcaacgtccagatgttgtttctcaaaatcatttgatcatcaggtttataaacaacagcgatttggagactgcgcggaaggttttcgatggaatggctaagagatatagtttcttggagcattatggttaatgggtatgtgagatatgggctgaagaagattgctcaggacctctttgatgcaatgctcaagaggaatcagttttcatagaattcattgatattcaggtactcgagatatggtagcgtggaagttgctcggggcatctttgaccagatgaggctagagtggagtgtgatcacttagacagctatgatctcgggatacacacagaatggccggttcaaggaagccttggaccttttcctcgagatgcaaattgcaggtgtggcaccaaataaaatcacgcttgtaagcattcttttagtggttgcacaacttggtgctctcagtcaagggaggtggatccatgcttacatggatagatgggtatggaagtggacttgatccttgattcggctctagtggacatgtactcaaaatgtggctgcattgaggatgctgctagcatctttgaaaagctcaagcatagagaattatcagcttggtacacaattaaattaacatagtatacagttaactaactatggtacacagtcaaataaatacaatacacagttaactaaatatggtacacaattaaatgaatatagtacacagttaaatgaacactgcacatagttaaataaataatatacacagttaaagtaacatgatacatagttaactaaatatggtatataattaaatgaatatggtacacagttaaataaacactgcacacagttaaatgaataatatacacagttaaattaacatggcacacagttaattaactatggtatatagttaaataaatatagtacacagttaaataaatatgatacacagctaaataaatattatacataattaaataaataatatatacgttaaattaacatggtatacagttaactaaatatggtatatagttaaattaatataatacatagtcaaataaatactatatatagttaaataaatactgtacataattaaattaatatgatacacagttaattaattatggtataaaattaaataaatatcgtacacagttaatttactattgtacacagttaaatgaatattgtacactgttaaattaacatggtatacagttaaatgaatactgtatacagttaaattaacatggtatatagttaactaactatgatatacagttaaactaatatggtacatagttaactaaatatgatacacaatttaataaatattgtacatagttaaattaataatatacatagttaaattaacataatacatggttaactaaatatgatatatagttaaattactatagtacataattaaataaatacggtacacagttaaattaatatggtacatagttaactaactatggtatacaattaaataaatataatatacagttaatttgctactgtgtataactaaattaatatgatatatagttaatttactaatgtacatagtggtcatccattagataagagatggggtcggcaagatggccgaaggcaaggccgaggagggcattgtcggcaacaatggtgatagtatatagttaattcaccattgtacataattgacttactaattaacatggtatacaattatttaaccactgtatacaattaaataagtacgatatacagttaatttattattatacataaataaataaatatgatacataattaatttatcattgtgcatagttaactagctactgtatatagttaaattaatatggtgcatatataattaacttaccactatgtatagttaaataaacatgaaacgcagttaactggccactgcatacagttaaattaacatggtacataattaatttattactgcacatagttaaattaatatagtacatagttaatttactactatatatagttaatttatcactgcacataattaatttatcattacatataattaattaatttttttaattaatttattattatttttatatagacacgtttctccgtttcaatcctcctcccatcattttatcatacataaagaaatggaaagaaagtatgatattaaattgaagatatttttgtctcgtgaggggtaaaagttaaagtcccattaaaaatagatcgaaagttgtataaaaaatcaacaagatttaaaaattaaagtttgatcaacaaatggaccggacattaatttttttaaaaataaacaaacaagcatggaatagtcctcgtaccatttgatatttcaaaagcaaataagcaatagcacaccgaagttataacccaaagatatagagcaactagtgcagacagcaatgattagccaatcttgaccatagcaatgcccagtttaccactttgaccaatacttggccacaaattctgtgatattcctatctgagcttgcaccctcccccactggccttttggccaactcccccaacttccttgcattcctcctaatctcctcactcctctgcccctccatcaccaccctcacacacctctcacctcctctctccccaccaatcccttctcactggccctcacccataccccaatcttccaaacatcctcaatatacttggcattcattggctgatctgtccattgtggcattccaatcatcggcacgcccaagctgatctcctctatagttgaattccatccgctatgtattagcaaatagctaactgcctcatgtgatagcaccgtcatttgttcgctccacaaaaccaccaacctttgctctgatgacaaatcttttataaagttttttgggagtttggaggcttttgaggatttcaccacccaaagaaagtgtttgccactgttgagaaggccgaaggcgagctctaccatttgatcgggcccgagtgtgaccatattgccaaatgatacatagacgacagagttggagggctgagagttgagccattgcatgcagagggcgacactcggactgtaaaggtggaagccatagtgagagtcggatgggaacaggttatccaagtatgaagatggcatggtggggcctatgatcttggcttgccatgtggacgccatgtagtcagcttcctgcttaaattttcaacaataagaaaggttaatttttcttttttacttctaaaattataattaagggtttgtccagacctagcttagatgcttttctttgggttgcaagaagaagaaaaagactcacagaggttttttttcttcccataggatttacattggatgaagatttgttgatacaaggttatgcttaaatggatggctcgatgcatgaatgttataggattttcaatccacccctgcagaaatacccaaatagacaaggaaaaggcccaaaatatattattagattcaataaaaaggaaaaaaagcccatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttactcgatcatgatcagggtaagttttgcctcgcctccttcctccattaccgtctttattatttcgtctttctgacggtcagttcccgtttgcagtcgatttacactatgtccgaactagaggccggataccggaggttcggggatgttcgggcagcccggaaggacaaggcgatgaccgccaaagtctaaaaggcggtactggtcgagcagttgaagctgtcgaccgatcgggaggcgaggcttgaagacgagatctctcatctcgaggccaaacttaagtcagcccgcggggaagccaggcacaagggtcggaccgctcactgactgtggcacgagcgggacggcgccgtcgtcgaactcgaggccgaatgcgagcagctctgggtcagcctggagaatctcgccaaggccgaggaggacttgtcaatcacccaagcctacgttgacatagcgaaggcggaggcagagtcggcgaaggagtcgttcgatcgggcggaggcagaggcgaggtcggcgaaggagtcattggatcgggtggtggaagactttcgcggctccgacacatatcgggaggaactcctgggaagtggcttcgcgtcgtactgggtggggtacgaagatgctcgggatgcagtccaggccttgtacccggagctcgatctcagcggcattgtccccccgggacccgaggaccaagccacagaagaggtggccgacccatcgtcaggagacgctactgtggtggaggaaaccgtcccagagcaaatcaccgaagaggagacggctccgacctccgacccagctctgacctccgacccggctccgacctccgacacagcaccgaccagagtggatacaccggccatccccgagctcctcccgatcgaagaggtcgactccgaagaatgatcggagtgttgtcactttttgcttcgctttacatacttgtaatcgggcttcggtccaattttgtagacttgatgaaattaagtattttcaacttcttcacttcgtatgttcagatgcgctctgacttagagtcgtagagtcgtagacccaacatgccatgttaggtcactcggtaacatcctaagtcgttagtcgtgatagtcggtaacgcgcgccatggaaaaggcaaagtaaatttcaattacagaccgtccatccggcggtcgtggtgtgcgcccgccgttggcctgagctgaacattccttcgcccggttgtgagtcgaaggttaaagtcgaatgtgcgtcgtcccgacatgagttgggcacgttcgttgagtcgaaggttaaagtcgaatgtgcgtcatcccgacatgagtcgggcacgttcgttgagtcgaaggccgaccgaccttcgggcacacctcgatgacccgatcattgcatagggtcgaatgttgtctgatgtgatcagtcggatggcgtccgacacgtttagtcaggaaaatgatgacaagtcgagtttccattacccagacctaggtcgggtacttacgtcgcaccgtgtgataaacggtggtaagtcgaatatccttcgaccggctgtgatctggtcggtaagttgcgaacgcgacgttggtcgcgttggtgctttgcctttctcggtcggggccgagtcggcaagtcagccgatcattttgcccgatcgttttaactgtagaaggagtgtaactcccatcgtcgtggatatatcagtccttttaagcatccgatgcatcgtcggcgatcaggccgttggtccccagtggaacgttaggctcaagtcgggacgtcggggctcgtacttcctggcgagcgccgacccacagtcgaagagtcgagattccagactccgagattttgaaattgaatttgtattccaagtgaggggatacaaagttcattggtagtacaactttaggttgtcggcattccaggtccgaggaagggcgttcccttctagagttttcagtcggtaagctttcggcccgtaggcatccgccatcttgtagggtccttcccagtttggagctagcttccctcggtctagaggcttcgagacttctgcctttcttaggactagatccccagacctgaaaagctttggtttgaccttggcgttataatattgggccaccttttgtcgatagaaagccatacgaagttacgcctcgcgtcaaagttcggacaagaggtctaagttggctctccgatactcggagttatccggctcacgatactgctcgactctggatgatggtaacccgatctccagcgggatcatgactttcgttccgtaggctaagttgaagggagattctccagttgggatacggggcgtcgttcggtatgcccacaggacagagttcaattcttcgacccataggcctttggcttcatttagtcgggtctttagtctgtgcagaataattcggttggtcacctcgacctcaccgttggactgtggatgcccgaccgaggtcagtcggtgcgtgattcgaaatctcgcacagaagtctctgaagtcttggttgtcgaattgccgtccattatcgatgataatggtgtgcggcaatccgaacctgaagatgacggacttctggacgaagtcctccatcttccgctcagtaatttgcatcagaggttcggcttccatccacttggtgaagtagtcgatcgcgacgactatgaacttccgttgaccggatgccggaggaaaaggtccgagtatgtcgattccccactgggcgaagggccacggggcgacgactggattaagctggctggcgggtcggtgttgtatgttggcatacctttggcacggttcacacctccgaaccaattcagccgcatccttcttcatagtgagccagtagtaatcctgttgcaggactttgtaagccaaggatttgccccccaagtgattactgcagatcccttcatgtacttctctgagggcatagtccgcgtcggtcggccccaggcacttcagcaagggaagagagaacgatcttttgtatagtcagccatccaccatcacatattgggaagccgcccaccagagtcgtttggcttccgcagggtcttcggggctagttccgtcggtcaggtactgagcgatcggatccatccaatttggctctgtcgccaattgcagcacctcttcgatcttgtcgacgctcggttgttccagactttttatgaatgtccgactcaaggtgccgtagtcggatgtcgcgagcctggagagtacgtcggcccgagcattttccgccctggggatgtgaaagatctcaaagtatttgaagggtgctacgagatcttttactttttggtgatatttggccatgatcggatcccgcacttcgaactcacctttgacctgtccgacaatcagttaagagtcagagaagactttgaggcagtcgaccccgagctccagtgccaacctcaagcccgcgacgagcgcctcatattcggcttggttgttggaggccttgaagtcgaaccggagggcgtgctcggtaaccactccctccgagttggtgagcaggaacccagccccgctccctcgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagttcgagtggggaacctcatcagttgtatttatgacggatgaatatgagagagataggacgaggtgggcaagacttgtggtgcacacggaaagggggtcgagttacggagagaggcgcaaaagaacgtgcaggagttgcggtggccaaagaaagagactaaagttacggagagacgtaccaaggagcgggttcattttgtttatcctctagcgggaaatctttgtcttgacactcctcacatattttgacacatttacatgaggcaaatacgaagaagtccatacgtaattaaaatgctatttttgtgattaatgtttgttgaacgatgttggactagtattcctctctcacgctccgaaccaatcactttggccgatcacatgacgtggccgcatgagtcttaagagcaattaacgtcctgcaggtcatgcataattacaagagagtgatcggaaagagagagatcgggggagtcgaagaatgatttgcattatggataagggagtggaagagagagataagatatatcgaaaaatttcttacaagcaaagggattaggacaatctaaaacaaaagagaacgatggtgtgcaaaaagaggatgttcaacaagttggataagctagtttcgagcaaaatctgttaagctattattcattttagagataaaaagataattttataattttaattaatttttaatttaaataaatataattttggctagcaacgtcatcaactaaaccatcatatcagggtattcatgtgcaatagcattttgaggatatacaaatatcaatttagaggggtattcacataaatttcaatatgtaagggatattcatgcaaaaagtacaaggatttttttcttatatatatgctcctaaatatgcgaaattatatgaatattcttataaagttactttttgcatatatactcttataaatatttctttttgtatatatactcatttaggatatttcagtcattttaattttaatccactgatttcttaatgacattacatagcatatgcacatattaaagaaaaaaaaaggttattcatgcaaaacaagtattttataaaagtatatatgcaaatataaatttgggaggttattcatgtaaatttcaatatgtaggatggtatgtatgtaaaaaattttaaaaataaacaaaaatgcatggaatagtcagatgtcccaaaaacaaataagtaatagagtaccgaaattataatcaagagatatagaacaactggtacaaatcgtagttacaattagccaatcttgaccaaaacaagcccagcttatcactttgagcaataattggccacaaattccatgatgttcctatccgagcttccaccctcccccactgcctttttggccaactccctccacttccttgcattcctcctgatctcctcactcctttccccctccatcaccaccctcacacacctctccacctcctccctccccaccaatcccttctcattggccctcgctcgcaccccgatcctccacacatcctcgatatacttagcattcatcggttggtccgtccattgcggcactccaaccatcggcgccacacccaagctgatcccctccacaatcgaattccatccacagtgcatcaggaagcagccaattgcctcgtgggacaacacctctatttgtgggctccatgaaaccactagccctcgctccgaggataaatcctctatgaagttcttagggagcttagaggtttcggaggatctcaccacccaaaggaagcatttgccgctgttgagaaggccaaaagcgagctccgccatctgatctgggccaagcactgccatactaccgaaagacacgtagatgacggacttggagggctgggaatcgagccattgcatgcaaggggcgatgcttggcttgtagaggtggaagccgtagtggaagtcagatgggagccgattgtccaaatatgaggatggcacggtggggcctatggtcttggctcgccatgtggatgccatatatccagcttcctgcttaaattcccaacaataggaaaggttaaaaattctttctaattttaaaattaaatataataaaaaatagaattaattttgagactatatcttaagttttattattgtagctactgtagcatcccatatgaatctggagaattcagacttatatatcgtatttatttcatataattgatttccttcatttcattgaatttgattttgccgtttgagcctaatccattctgtcaataagatgatgagaaaatgatcttctcaagagatacagaaatgctcacttattatctcaaagagaagcaagcagaacttcaagcttagctactacttgctaattgctgattcaaaattgatttaccatgcatggtaccggctctattgcgacgtgttgaacgggaccacataaaaaagcaagaataaaagtccacaaaagtaatttacacccaatcatgatggtgaaaggtaacaacgccataccagcaaatcagtcgccaattgcaatgtggatgacggaaagaatgaaagctaaaaataagtcattcatgtgttgaagatatatggctcgggctaccttacacaaccatatcagtgaatgaatactttttatcaacatggcaaagagagccgaggagaatatatcccaagctgtcacaggttatcccaagccaattacaaaattgagctaccacaaaaaatggctatcgcaagtccatcatccagaaaaatcgatagatgacaaagtcaacgaattcacaatcatgacagcgaatctaaaattgaaatttagcgactaaggtagtatattcgtgtcaagagaaccactggaaaatccagcaacatgaatagaggcaaagcacgagatagaatacagagtgaaagtccactagtggtacaaaactgagctatactagaattggctcgactctaaaatacttggagttagaaattttggagaacttaattagttatatacatggctttcagccgcaacaaattgtttgactgtcacctaatattttatctctagtaagacaaactagatatatggtatggtgctggacgaaaattcgccaataattgggccgggattttatatgcgaggcaaatgccgagggatgatcatttcattatcgaaggtggctcgaccatggtggtaatctgaattcagttactgcactcgagaaggtcatgttcgtcctcttcagaaagatatatttatattattaggatgttgtatgcgtgttattaggtatattttttggaaagtagatgctacggtcgactggatgatagtttttattgcatagcatttgggaggatctttttgggttgaaggggtataattcttgatttttttaaaaatattttattttctaatttttttgattatatttatattaaaattttatcaaaaaaaaaaaacctataacaagtcatcaactaggcatatttatataggatggatgctagaattttttttttttttttaatgatgaacgctacaaaataatgttccaaaatttgttataaacaaaaagaaaagtaaacgtgtcccaatctttgccaaacaattgcactaaattaggaaacatgctgccccacgtcctataattccaaatacattgcatctgatgacaataatgataactcccctttctgtttgttatgaccctgcccaccataagcgtaagcagtatccttatcctcacttttcaccgttgggactcgcttttcagggttcccaggtcaagatagaatttgtacttcactggaagtaattaaaattcgtactgtaggaaaaggaacaggctctgacttgatccagtggaactcttcttgattattatggggcaccggtctcttgaacatttacagttccctctgccgcatggtaaaagaggcttcgtgtaacttttgaaaattaatatgatgcatggaaaaggctcaaaatgttttttaggttcggtaaaaatgaagtccatgatgtacagggctaactcgcgttcattatccaacaaactcctgctcatctctgctctcatattgaatccttaacaactcaagctataagatttttttttcttgttttttttttttaaatggttctatctctctctctctctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatcaaattaataaattaattcagccatagattcgatcaaatcaggatcatttctcctttatcgattaggtcatctcataacctaatcaaacttgacctgattgaatccaattcaatcaaacttgatccagaccttaatgctcaatcaaattgagctaattaataatctaattactaattaatcttccattaataatagagtccaagtcttataggatttttctctagagtctccatccagtaggactcttcagcagagtttccatccactgggactcttcagattagctatgtgatcggagagaaacttctaatgtgtgtgaccccataggttcgaacttaagccggtagcacagaaactaatttttgtaccaattggagtaaccatctagcaagggtgcccgacgttcggataggccgaatatatgcgaagcaacactcaagagtctatttgaatatagttaccatataattcatccctttgatccttgatgctaggatgacttagagtttaaactgtcaactcgtaatagtacatctattatgtatctcaatctaataaattctgtgactcctcataaggattgtcctggccaaggtcttactcaattgaaacacaaagcattctctccaatctcttgaagtactcaattctatcttgactcacgcaccgacttcacaagtacttgactatgcctagaaacctttcgatcctgaattaaaaattcaggtagtccggcatcaaagcacagtgagttgcttgcaagttaccatggtgatctcagatcagaggaacacttatacccatatcccttcgggactcttgacagcagaatactccagagttgatcacgtttagtgaaatatactcctacattttatctgtatgccataccagcgtctccacactccttgattaagaggacgaccaatgatatatagcacacaatgatctatacttgatatatctatcatcctagtaatagcatattatttgatcgcgaacttatttaaggactaaatgataaatcttcttttatcgatttaaaatagtctcaagaactttcattataacacagacgttcgatatagaagatgtacaagcttatgataaaaattatcaaataaatattttattaattaattcatatacaattacatcaaatagtacaatcgtcaacaggttgacgattgattttgggacatatttttcaataactctcacttgtactaaagtcaattggtacagtatcgtatacccatcttcactttatgatcttcaaactcctttaccataagggctttagttaatggaccggtcagattctctcttccatcgatcttctgaaggtcgatatcacctcgatctatgatttctcagatcagatggtagcgatgcagaatgtgctcggtccgctgatgtgactttagttcttttgcttgagcaataccatcagtgctgtcatagtacaacaaaatgaggccattaagggagggtgccactctgagctcgttgataaattttcgtaaccacacagctttcttcacagcatcgaatgtcgtgatatatttcatctcgtaagtagagtcggccacagtatttgcttagaactcttccagcaaattactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatagcctttcttagaattctccatgctgaacattttcagcacagtatcaatgtatgtcgactgggataatccaagcaatcttttagatctatctctatagatcttcatcccaaagatgaaggatgcttctcccaaatccttcatggagaattgagatgacaaccaaatttttattcctgataatgcagggatgtcattttcggttaaaaaaatatcatccacatacaaaataagaaatactattattgagttattaacccacttgtatatgtagggtttctctctattcttaatgaagccagacattttgatcactttatcaaaatacatgttccaacttcgatatacctgcttaagtccataaatggacctctgaagcttacacacctttgatttatctgtggatatgaaattttcagattgtatcatatacatattttctttcaactctccatttagaaaagttattttcacatccatttatcaaatttcatagtccagatgtgctgctatcgcaagcatgatccgaatggacttgagcattgccacaggagaaaatatctcgtcatagtcaataccagaatgctgacggtaatctttgacaactagacggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttataggtctccacctttccgtctgcgtccctctttcttttgaagatccacttttatcctatgaattttatcccttcaggtaggtcaaccaatatccatacattgttgactttcatagactccatttcggatttcatgacttccaaccacttatcggagtcagacttctacaccgcatctatataagtgatcagatcctcattgttctcgtcgagttcaactggatgatcatctcggactaagaaactgtagtatctatccagttgacgtggtactctaccaaatctacttaaagatatttctacaacagattttggatttgatctaatcaaatccaactcaataggtttactagattgtgtcggttcttctaccgatcgaacttcattaagttcaatctttgaggtattagttccttctccaagaaactccttttctagaaagattgccctattactgataaatactttctgttcgtcaccaaggtagaagtaatatcccttggtctcttttgggtaccctacaaatagatacttgtcagacctagatccaacttgtcaattttcagacgtttgacataagccagacatctccaaactctaaaatgagagaatgcgggtttacgtcctgtccatatctcatgtgatgttttactcacagacttactcaaaattttatttaaaatataacaagccaactcgagtgcatatctccaaaaagagatcgatagacttgcaaagcctatcatggattgaaccatgtctaatagggttcgatttctccttttcgatacaccattatactatggtgttccaagagagatccattacgagagaattttattctcttctaagtatgtcaaaaactcactagagatgtattctcctcctcggtcggatcgaagagttttaatactcttctcagtttatttttttacttcattacgaaatcgtttgaatatttcaaatgattcttacttatacgtcattaagtagacgtacccatacctcgatagatcatctataaaaataatgaaataataatatccacctctgacactaatgttcatcgatccacatacatcagtatgtatcagacttagaacttcactagcttgctcatctttttcagtaaaagatgacttgatcattttttcaagaagacaggactcacaggttggaagtgattcacaatcactgacttcgaggatctcctcttgtgtcaacctatttattctgttcttattaacataacctaacctacagtgccaaagatagttattggagacatcactaattctagaacgtttgctagacgtgtacattacactaacaggttgtgacaatatgtaaatatcattgttcagctgtccattcatcacattaacaccattcataatgatattaaaattatttttttattaaaatttcataaccatacatgaccaagagatctacagaaataatgttcattcactaagaacaattgtatttgacttaaatacaagcttaataattcctaacgctagaactggaactgatcttccatctccaatattaaaaaaattttcaccttcttcaaatctctcactgacttagagacgttgcaacgaattacaaatattaaaaaggcttccagtatctaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtgatctaatcactaattaatccttcattaataatagagtctaaatctagtgggactcttctctagaatctccatccaatgggactcttcagtagagcccccatcctccgagactcttcagattagccatatgatcggagaaaaacttctaatatgtgtgactctataggttcgaatctaaatcgatagcacagaaactgattcttgtaccgattggagtaaccatctagcaatggtgcccgacatctggataggccgaatgtatgcaaagcaacactcaagaacctatttggatatagttaccatataattcatctctttgacccttgatgctaggatgacttagagtctaaactatcaactcttaatagtacatctattatgtgtctcaacctaataaatcctgtgactcctcataaggattgtcctgatcaaaatcttactaaattgaaacacaaagcattctttctaatctcttagaatggtcaattccatcttgactcacacaccgacttcacaagtacttgactatgtccaaaaatctttcgattctgaattaaaaattcaggtagtctaatatcaaaatatagtgagttgcttgcaaatcatcgtggtgatctcaggttggagggacacttatacccatatcccatcggagtgactcttgacagtagagtgctccggagttggtcacgtttagtgaaatgtacttctatattccacctgtatgccataccaacgtctccacgctccttggttaagaggacgaccaacgatatatgatacacaatgacctacatttgatatgtctatcgtcctagtaatagcatatcatttgatcgcgaactcatttaaagactaaacgataatcctcttttatcaatttaaaatagttctaagaactttcatcataatacagacgtttgatatagaagatgtataagtttatgataaaaattactaaataaatattttattaattaattcatatacaattacatcaaatagtacaaccgtcaacgggctgacgattgactttggaacacattttccaacagaaggggagacagagagcactatttcacagtaaaagaaaggagaaagagaggaaaaagagagaaaaagagagatggaagaagataggagggggatgatggatcctactgtttgggagagccatccgattgttgaagagcagccaagggagtgtggacatttcatcaaaggcagaaatagaaaatagggcctgttgctactgaaaagagagaaagaaagggacagatacagatagagaaagagagggggagagtgagatgaatccagtagccaaagatgaatggccgcatgccatctccttgcaagatggtagaataaaggaaagggtgggggggtgagactcttgaaaggctaaagaatgggggagaaaaaaaaggaaaaagaacaaagaaggaagagagagggagaaagagaatttggatagaaaagaatagtggaaagagagaaaggcagagggggagggtggaggaggtgcccgacgaggagaaagaagaagagagagagagaaaaagaggagagaagaagagaagagagggagactagaggagtaagagagagagaaagagaggtaaggggggagagggaagaagaaatgaggagatatgcggtcgaccgactttggctagccaatggcagaaaggagagagagagatagagggagaggatgggggagctaggaaaagaaagggggaaggagagagagagaggggagaaagaggggcctgacagccggccactagagggagagctttggttggagaggtgcttgaggtgttcgtcgtgaagaaaaaattttaggacttctctctctaaaaaggcttctgatgagttgtatataattaaagtcatcacggctgaaaataatatatgaacaataatttttcttaagtaaaatgggttggaaatatccatcgaagaaaatataggaagttgatatttatatgctattgccaagatatcacattatacctgatttactagattcaatggcaggtcattcaaatcctaataaccatggttcaacttacctcattaatttatcaatctactgattgattgatttacttctgtaaatctgatgatgtagatatgacatatgcacttgaactagtgctaaagaagttaataatcctactcaaatcattgttggcaaagatataattattcaaattaaatagacattgtgaattgattttgaaaatttgtatttaatataaaggatggcatagtgcataaaactatagttattgcaagatccagagaagatcagaattggataattaatttaaatttataaaaataatcaggtgatcatatataaacttataaaaataattattttaagccttaaatcaaatctaatatatatatatataggtctctatattggcagggcctccatttgacatgtagggttttgaaaaaaagaagaggaagccacgttaaaaaaatagctatcacctaggcttctctattcaactgcttcgttcgcttcaagccacccacccgattgagactcctgaggatgcctctccatcatcgatgaggatgttggcccccatgatgaacccgatcatgatcggtacaatcgttctgaggttgagagcgtacatgtgtggagaggggacgagggcagaggaggtaggaataaggagaaggtggagtcagtgagaacggggagggtgctacagaggaagctgatgagcttgggcttcgtgatttccatctaggttatacagacagctgttgagaacaggatactactggccatctatgatcattgcttgcatgcaatatgtcaaaaaatatctaatctatcagatacactcacatctgtcgcatgtgccgaccaaaccatcccattaagtcttattggccgttccaatgttggggactggacctaatcgagaaaaaaataagcctttaagttgggtcacgcatggatcatcaccacgatcgaatacttcacaaagtgggtggaggctgctcctttgaggaaggcgaccccacacactggagctccctcgagccctccatggggtccactgctcctcctctgatggaatccaagaattagagtttatagtttggtgccaaagtgtcgacatggatactagcacccatcggaggctgggagctctgatgtggatcatcgattcggtatgcattattgtagattttttttctccctatattttttcgactgatgagatgtggaaccacagctataatcaaaacattggacccaaacattctctgcatgatggatgcggtgccttccacgcgtgcgtgcatatagcattgtttgggtaaatttgtattagctcatggccttggtttgaactatttgattgatacaattaatttgttataaggatgaagaaagcagtaggggcatcgctgtggtggtggtggatgtggaagagggtttctcatattttgattgggttcttttctgaaggatataggattttgtgcgagttatggtggtgtaagttggtcccttttaggtttcaagagcttaatccaagatggtgctgaacatggaggtgaggcagaggcaaatgtgggtggtggagctacctcaggggaagcaaatgatcgtgctccatgttctagaagggtttcttaagtttcgattgggttttttctaaagggtatgggattttgtgtgagttgtagcagtgtgagttggtcctttgaggttttgagagcttaatccaatctaatgtaatatatctaacctttccccacttagatgatttttttcttttctttttattttattattttttttagagatatgtgagaaacgagagcacaatgagagagattagagaggtctctaaggttccaattgcttttttctgaaggatatgggatttgctgtgagttggtcccttgagattttgagagcttaatctaattatatatatatatatataaaataaaatggaggtacctgtattggcttctttctccaatctcccatgggtcagatcttcagaaaataaataaaattaaatattaattttaaaaaattacaccacataggttataagttagtattttatatatttgtaaggattttaagatttgaacaagcacacttcaaaatgtgccaacttcccgactgatgtgattggttaacttttttgtaaatttatgaattatgataacacatgatattccagttataatcatataagtataattatttgaaataatacttagtttaaattgtaaaaaccaaaataagttattttctcccaatctcccatgatgctatccatttgtccttcgtattcaaatagctatcaaatggcttaagagaggatgcaagcgtgcataatatgcttctatgattaatgctcttgcatgataaaactattggagaatctctcatgggtgcgaatccccatccaagaacgcaacatcgatgacgatgtcgataccacaagtcgaaggataaaaaaagaaatacaaaatacaaccaaataatatagattggctcgaggcctatctccacaaggtatgcaaactgctttatgagagaaatctacaaatacaaggtgagatcataaactctcaactctcgtacaacaatctctcaacatgaagtatacattcattacaaaaattctcaaaatccttaaagagacacttcagtcatcataaatgctaccatcaagtcgtagaattcatcgcaagctttttatagagcctaacaatacctaaaacggatcagaaaccatcaagttacactcatttaaactgaaataaatctcaagcatctaatcgccattatgatgcatagataccattgaacaccatttttttcagtggctcatgcatcagatccgcatctccacagtagtcccagcgcatcccaatcgccagccatccaatcgagccaatcggatggtccagaagcctcctacaacaaatgttggtccaatggccgattcagggcaccgtaaccagtccagcgactggtttagcaccaattcaagctggttcaacttgatttagctcggtttagggtcggcttagttggttttcagttggtttattgttagttcttcaccgattcacctcagaattgactggttcaccttcggttcgaacccaattgagctcaatcttgtgatttctctacctatccttgagtcttgggcctttattaaccaatcaagatcgaattgaaggtgtcaaactcaataaatctctacctcgactcaatattcggcctccacataaatttgagagcttgtggatgatctcgcccccatgtcctgggacaaatacctgactactcttggatggacagacataaaagtcgagtcagatcactcgatcccatctccatcatatgttgaaacctgcctgacctgagacatacctgtggtagcctcctgtggcaataagaatttcactttgcaatgtcacctatcatccttccaagccttctgtctcgtgcccaatccacctacacctggagctttatctcttgctgagctccctaccaaaagatagtatcctccacacttctttctcttcaatacaatcctactaccacgcataatcttcaggactctagcattagctctccatttgtagctgcttgaatttagtctactcagtaaaatcagattactcttgaaactggatatgcaacgaatctcacccaactttctcactgctccatcatgtgtatgcaagctgattatcccaatacctttgattgcacaactcaattcattcgataaataaatagtaccctcattgccctttagagagagctcctctctataacaaacatgatgtgagcaagctgaatctaaaattcactaaagaaaagaagtagatacctcatcaaagatcatatacaaatcatcatctcatcagtgtcgccatcatggaccaccacctacagtagccttcatctaatctttgagctatgaaaaatctctgactcgatgtcccaattcatcacaccagtagcatttgatcttgctcgaatccctcgacttggacctggaccgcctatcttgcgatcttttgccgccaaaatcaagttgctacctaaattcgagactcaattctcacgtctgagaatctcgttctgaaaaagtatagaagtgatctcatccatcttgatggtgctcttctctataaaaaaaacagtcactaaagactcaaataaagaagaaagcgacgaaagcaagaccaacatcctgatcttttcctcaatattctcaccaatactaaggagttcagtgaagaccttttagaagttgctaagatactcctatatgctttgcccctcgctcatccacaactggtagaactactttcagagaaagagagcattggtgagagtcttcaccatgtacatcttctcgagcttcgatcatatcgccgtcagagaagtctcattaagcacatggatcaccatatcatccatcaagtacaaacagatcatgctcaccatttgcatccaaagccacttccaatccttctcctctatggtagtgatttcttctcacataagatagcatcaatcaatccttgttggatgagcacatccttcatctttgcttgtcatagaaaaaaatactctttccatcaaactgatagatctctatcttgattgagcctatcttctccatcttttccaatctcgatcaacaccatcataattcagataaccctatgctttgatgtcacttgttgagaaatctctcacgagtgcggaatatggatctctatccaagaatgcaacgtcgatgacgatattgataccataaaaagaaagatggagaaaaaagtataaaatataaccaaataatatggattggctcaaggtctatctctacgaggcatacaaacttcattatgagagaaatctacaaatacaaaaagatattacaaactctcaactctcatatactaatctctcaataaaaagcatacacctctcacaaaaactctcaaaatcctcaaagagacactctaatcattataaactctaccaccaagtcatagagctcatcgcaagcttttgatagagcctaaaaatacttaaaacgaataagaaactactaagttacgctcatttgaatagaaacaactctcagtcatttgatcactgttctgaagcgccccaatcaccaaccatccgatcgtgccgatcggatagtccaaaagcctcccaccacaaattttggtccagaagccaattcaaggtgctgtaaccagtccagtggccggttcagcaccaattcagactggttcaacccgatttagaatcgattcagttggttttcagtcggttcttcactagttcaactggtttactgctggttcttcacctgtttaccttcaaattgatcgattcagctccaattcgaattcaattgagctcaattttgtgatttctccatcaatccttgagtcttaggcttctattaactaatcaagatcaaattcgaggcatcaaactcaataaaaactttagttgaatagagctagggaggacataccacaaaatggagaagtatttgaaacaaagaagagctatgaaaaagattctatgattaccaaaaaaacaaaaaaaggtcctatgcatgataatatctcagagcgatgcacttggaagacgtgttgagaaaaatatattcttttatttcaacctttcagaaaaagcaactctagagttgacgtgccttatgtatggtttattaagtaatgatactagtatgcgtacatagatatttaaaataccagaacttctcacacaaagaagatacaagtttagactatataattatatatcataattaatttataggaacaacaatatataatatgcatacatagatatcaaaataggatgaaaggtgtgattgttttaaatgaaactaagtggctcaatttcaaagttaaaacatcactggtgacaaatgctattatcgaaacataaaaaaagttatcgcgaggccctggacaatctaactgggacaacttagcagttgatatattttggcatggtaaagtaaacacaagtgcatttgctttccctattagaatacaccaccttagtaagctggatgaaaccaatctcatctacttctttgcgagaaatctcatcacacgaacattacaagatcgattttttataaatattgccatcactcttggcttaccgatcaattattggttggatatggtccatagtgtaccatagattatttaattcttcttcctccaatttttcttcttgacacacatcttatcatgcatttaatatctttttcgtcctaaacaacaaatattactgttgctgcgacactcaaaatctgagactggggcggatcggatgaagtcaagctggaggtcggtagcggtccaatctaaaacgcttcaaaaaaacctacaaaataaatcaaaaatcaagtgaagatcttttgattcttaaccttctgatgcttaagtcagtctttacccgagaacagtaggtgaaaaagaatagaagagcataagaagaggatttgcatggaactaaagaaattagactgaataggaactagagtccttattcaagaactgacaaagttttcactgacatagtctcactctgattttagaattagaattttaaacttaccattggaggatctctgatctctatttatagaggggttgatgagattgttatagagtctgttaggccattagaggagtttgttagacggttataggcagctataagtgagctaaagtatagctatatgtattagctagaagtgagatcatatatacttagctgcatgtatcagctggggatgagttcatacttagctatatacgccagtcagaaatgagttgtaacatagcgatagcaacctgaaagacagctataaaataaccatctatattttgagattatatcaattcagatcggtagatagctgaactgatcataatgcttcatcaggagtagattcaagttagctcagatcgatgtttagataaattgaattgaatcaaatcgatattctatcgatctgatccagaaataaattttgatcaatataattctcaaataattctttctaatattatcatgtgccagagatggatttatgatgatgttagatcgaatttatgatgatctcagcctttcgatgagatcagaattatgatgatctcaatcttcagataaggtcggctttatgatgatctccacagtcgagttttacatcagtattctcatcaattcgagaacttctgtgtctcgaggacatcagctgaggtgatttctgaagaagttgctttgaacaaaaaaagtagtctaaaaaaaaagttctcagcttgtctgaggtgatgaatccatgtcatttggttcaagtaaaccactgcatccctccacttgagatcgaagtgggcaagtcgggtcacttgcatataacttttgacctttagattttcctctttgagggcatatcttcctgagactatgactttagtcataagtatctttgaaccgatgttgcaaagtccagcccatagatggaggtgcttcacatcaaatgtttgttgaaaatgaagtattttaataagtatttgtatggtccaatccggagatcaggtgtctcatctcatctatgaggtagtgaggtccaatccgaagatcaggtgcctcacttcaagttatcctgatttggttgggagtattattgactttgatcagcttttcccaaccttgttcagacacttattcttttctttgtcctcgtttgataggagacatttgttgtgatctaagggtcgaatggctcggataattggctcatgcctccgcacctgcacgtaaggtattgtcctctttggccttgatcattttcgggcttcaataagcctttggcttcaatgggccatggtcattttgggcctcatggttttgccttacatgggaaagaaggtttcaattcatataagctaaactccctcttgactcacaaccgatatggaactaaactagctattccctcataataatatatatattggtttgttagacctctcatagcccgatctaagtttaactatcctatacaggacttgaaaattattcataaaaaatattatttgatctcgattgggtcagttataaagttaatgtgctcatcaagataagtaaatgttagaacattaaaataatctgactttaagaattagattggttaattaagaacaaatcgatactaataaatccaatgtgtatgatagacattttaagaaatatctctgtccgatgtcgtcgtggatagattggatcccccatatatcagatgattttctctttacaatatcttatcttcttcccttttaaggatacatcattcgagaatttgagccaaaacttgtcaagttaatgccttatgaggtcaaccttgaatacgttatagtcttaatcagaactcaggtccaatcggaacttcagattttgatgaggtccaagcttcaaggagccttgagcttcatcaatgtggtgttcatcttgatgaactggttgatggctatattgaaatagagccctcaggggagttacttctttttattgctatttcatatttgtagtctttctgaagagatcaatctccttctgatgaacccattcgatgagatcgacctcctgatgagatcgattttttgcagagctcgacctcctgatgaggtcggcttttttataagctcggccttttgttgagttcggactcctgttgagatcgattttctgctgcgctcgatcttttgataaggtcgactttctaatgagctcgatcttttgctaagtttgacctcctgatgaggtcaattttctactgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagacttagataattatatttataattaactattgcggtcaaaggggttagatagctcagatgattgggttaactctactcttatatatataaggtattgtccgttttggcttatgaccatctttggacttcagtgaaccttagactttagtgagtcttgatcatttggtgcttcataattttatcttttatggagagagaaaatttcaattcatattagtcatacttcctcttaactcagaactgatttggatctaaagatgccatccccttacaacataaatattatctgaccttgattgggtcaatcatgaagcctatatagtttaatataataagtaaacttcaaaatatcaagaatgacttaattttaagaattagatcgattaattgagaacaaatcaatcttaataaattgaatgtaataaaggtttaagaaatacctgtttgatatcgtcatgggtagatcgagtctcccatgcattagatgagttttatcttgagatatttcatctcctttccttccaagagtatgttgtatgttacggataaaatccatcctagaccagaggtgctggagcgaggcgatgtctgacagatcgatgatggtcggacctttttataggtgagattggacccttggaaaagagaaaatcagaaaggatctttttgtccctcatcatattctcgagcatcatgtctagtcctttgattttctgaattggtgagtgttatcatctcacagtacatgagggccatccccatcaataccgtgagttgacagcttagactttaaggatggcatagtaaagtggtgcggcctgatgagactacacagagagatctgatctcctgtggataagaattgacatattgaaaataattttactgaaagttcattgtcagtgcactgtcttttcagaaaagaactttcatctactcccaatcttcactaagatttgatattatgttgatgatcccagtagtaggtagattatgatggattggttgctgattgtgttgagatagagtttcttgagaaactacctctaattgctactctgtggtatattaaagtggaggtgaaactgcttctgacatacttgtaggggaagatggtgaaggcatagagttattttgtactttctgattcatcattttttcataaagtttttttgcagactacccttcctctagcaccaatctgttgttgtgagactcaaaatataagactggagcagatcagatgaagccaagcaagaaatcgatagcaatctgatttgaaatgcttcaaaaaaatctataaaataagtcaaaaatcagatggagattctccagttcttaacccttcgatgcttaagttagtcttgagcccgaaaataataggtgaaaaagaatagtagagcacaaaaagaggatttacatggaactaaagaaattggactgagtaggagctagagtccttgttcaaaaactgacaaagtttctagtgatataggcttactttagttttggaattaggattttaaactaactattgaaggatccctgattttctatttttatagaaggattgatgaggccattacagaacttgttagaccgttagaagagtttgttatgcggttatagccagctgtaagtgaactagagtataactacatgtattagctagaagtgagatcatacttaactgtacgtgtcagttagagataagttgtaacatagttgtagcaagctgaaagacagctgtaaaataattgtctgtattttggaatcacattaattcagatcggtagatagccgaactgatcataatgcttcatcaggagtcgattcagattagtttagatcgatgtttagatgagcagatttgaatcaaatcggtattcaaccgatctgatccagaagtagattttgatcaatataattctcagatgattctctctaatattgccacgtgccagagatgggtttatgatgatctcagccttccgatgagatcagctttatgatgatctcagccttctgatgagattgactttatgatgatctccacagtcgagcttcatatcgatattctcgtcaatctgagaacttctaaattatgatgacatcagctaagatagtataacccttacaacagttactatatatttaatctcgttaccctcatcctaagtaccaaattatctaatttctttggcttatccgactgcaagccattagaattggtaaaattgaagcaggattttcatttccgtatccataacatcaaagctgcctatataaaaaaatattaagggaatttttaaaaaaaatcacttgaccacgggtgccatgatctctgtctctaaacggccctggccagaacgttccaacatagttggttgcctcccaaagaaagctaaagggatttgttgcacatcatggctgacacaatttttgggctaaaaagagatattcgttgggcgttctctctctctctctcagaaaaacatcacccggcgcgtagcatttagatatcatcagttggaatgtgtctaattgagctcatctggatatggccggtacgaatttgttttcgttattttaatttgatcgggactctaattctagataaatctcaggagatggaatatattttatagtaattgcgataaaattaaattctatgtaaccatagtggagatagtccctatcttaatttctccataactaaccataatactacctctgatggatcacgctataaaaggaaattctagagacttggttcccaacttatctaagagtacttgtgaggttcttcccatcgtgaatacttaagagatattagtactctactacattcgaaatgatttagataagagcatattgtgatcacaatatatatcttaacaaaggtatgggcagcatatttaggaactaatgtctatttaaataactaattttcttacttttagaaagattgctgacccattttgggctaatatgattcaaacacgaaatgtaagttgtcgaagctattaccttctcaacttaaatgtcggaataaaaataaacaaacaagcatggaatagtcttcatgccatgtaatgtcccaaaggcaaataagcaatagagcaccaaagttaaagccaacagatctagaacaaccatcgaaaaacagcaatgggcttgacaaaagccaagcctagtttatcactttgatgagcaatacctggccacaaactccgcaatgttcctatccgagcttccaccctcctccactgactttttggccaactccccccacttccttgcattcctccggatctcctcactcctctccccctccatcaccaccctcacacacctctccacctcctccctccccaccaatcccttctcattggccctcgctcgcactccgaccctccacacatcctcaatatacttggcattcattggctgatccgtccattgcggcactccgaccatcggcacgcctaaggtgatcccctccatagttgaattccatccacaatgcgtcagaaaacagccgactgccttgtgggatagtaccgccatttgtgggatccacgaaactaccaaccctcgctccgagggcaaatctttcatgttctccggaatcttgaagctttccgaggatctcaccacccagaggaagcgtttgccactgttcagaaggccgaatgcaatctccaccatctggctagggtcgagtgcggctacagtgccgaaggacacataaacaacagagttggaaggcccggaatcgagccattgcatgcagagattgatgctggggctgtgttgtaagtcgaagccgtagtgagagtctgatggaagccggttgtccaagtatgaggatggcaccataggacctatgatcttggctcgccatatggatctcatatagtcagcttcctgcttaaatttccagcaataggaagggctaaaagttcattctaattttaaaattaaaaatataaaaaaagaattaattttgtgactaatcgagggtagagcatgagaatccaaagtgcaaaaatcctcaattgctgcaaagctgggctataatagaatagaaatccataaagtatattatttttttatctaaatattatctaaaaaatacttacttaagaaaaattgagatatccggataagttattatcctcaaaagaacggtcctaacgcacttctaatcagaatctctggaaatctaatttagttgtatacaaggctttttgctaacaacaaattgtttggctgtcacctaactagtatcattagtgtggacaaactagatatagtgtgatgtcaaatgagaaatagattatacctagtcataaagtgggtatgtttgtgagctgaatgctagaattattttttttcgtaaaaagatgaatgctagaaagtaatgtaccaaaatttattataaacaaacaacaaaacatgtctacatctttgccaaataattgcactaaattaggaaacatgctccaccatacatgttaaaattccaactacattgcatttaacaacaggatgataactcccttttccaattgttatgatcctaaccaccataagtatagacagaatctttatggtcacttatgaccgttggagatatttaggatcaatgtggatattcttatatattggactacaaattctataagaattgggcctattgacctagctagcttaaattatctaagaacacgttcaaatccaacctagaatctggatgttggactgcaagaagaaaaaaaatccatcgagatttttatttttatttttttccttctaggatttaaactagcttgtattttggttgatacaagaccacacttaaattgactgtttaatctacgaatcttatggaattttgagtccagttatatggaaatatgcaaacagcatcaagaatttgtgctgcaccagaagtaataaaatttgtacggagggaaaggaattggctctcattagatcaagcggaactcttcttcatccttgcgaggcaccggtcctctagtagtacacttaagagttccctttgccacggggtatgtgaggtttatgatgcatggaaaaggcccaaaatattttttaggttcaataaaaaatgtagttaaggatgtacctagttaactcgcactcattatccaacaaacttttactctatctctgctataacactgaatccttaacaacctaagtcataagtttttcgcactcattatccaacaaagttttactcatctctgctctaacacagaatcgttaacaacctaagttataagattttcaaatacattggctactccacatttaaaaacaaaaagtagataccattttttttccattttaatttgcagtcattttgtccacgtcatctcggatcgcatgaagatccaggacccacatgaaccgtagtccaaatcctttaataacctactcaaagaaattaaattattataatcgagaaaaatttcacgaggctatgcaattctgttttctgatccccatccagagagtagaagtttcttatagaccgacttgcagagaatccatcatgcataaattgttgttcataataatggcagctattggatctcactccgctctcatctggcacccatccacatgatgggagaataacctccgatctaatctggtacctttcatgagagattgaccccaatagctccagtgatctagactttgagcagcacaaccaatagaaattaatcaatcacgcgtcactacaatataacctggatgaaaaatttaggccagcactggatcctgtcccagtttgtttctacgtatcgggttagagtcgaacacagatacatacctcaggctgcagctcgtaggaggagttgacaaagaccacatctgccttctccaaattcttatactgctccagcagcgctttcaggcaccacgcgtacgccaaatccgcctccacaacgaaggacggcaggcagtccggctcgagccggggcaaaccgggcagcgagaccggctcggtaaccggcatccggagccggccctccttcacgagcccgtagactatgttaacgctgcagggctgcgtgaagagcgacaccgtcaccagcccgtgccgctccccgacgtcccgggcccacgggaggtgggagtcgtagaccagaacccggaccggacggcccgcggcccgctcggaccggacgaggtcgtcgagggtcgtggatccgaccgactcgaagcggtcttggtaggctgggccggagccggcctcggcgaatccaccccggtcgaagccatcggagatggaggcgagggcgaccggtccgagttcggggcgggtggtggagaggaggaagcgggtggtgacgagggtggctcggaggccgtgggaggagaggcgcttggcgaattggagcatgggattgatgtggccttgggccgggtatgggaggaagagggcgtggggttggtgggtgccgctctccatcctctcttctctaagttctcttctcttctcttctctttttaaggctaaaactctaccttaagctagggagatcgagatcgagagatttgagcggctgtgcatctccccctttaaaggggaaagttatcccctgccgttcaccccgaacggcagaggatcccgatccggaacggagagattgtgatgtgatgcgagtcagcgacagagagggtctgcgcgacctttttttttatttttctctggtaagaagagtctgcacggcttcgaggggggggggggggacgtttttacaacgacatgctacatgtactaaatctatagtacggtctgaggttcaaaataaatataaaaaatatttataaaaatttatttaaaaattaattataaaaaaataaaaaaaattatttaaaaaataataaatattaaatcccacaaatatatgcctccacatatgcaaataattttttcgtcctctttcttctcaaaatattaatttttataattctataatatttaataattttatagttccacgtattaaaatgaaatctagaattcctttcaataggtcacaatgtggacaagaatttaactcctattttacttcactatccaaaaacctattgaacacaaatactatcgatcttaaaaaaaataattaaataaatttttattaaaaataaaattttatttcaaattagatatctaaaaaaatagctctaatattttagacaaaaataactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatggtattttttattttttgatattttttagatattttttaaaaatttaatttgaaatttagttactaatttaaaatgatgatttttatttgaattaaaattaaaatttttatttttttaaaatttagaattataatttttatttttttatttttttggatctatttttttagatattttttaaaaaaattaatttaaaatggagatagtaatttgaaatgatgatttttatttgaattaaaatcaaaatttttatttttttataaatttaaaattataatttttatttttttatttttctttttttggaagtaaataattaaagtcgccatttgaaatggcattttcaaaaatgccatttcaaatgccaactttatttttttttttgtcatccacatggaggagagagggtgatgatgtggcggctataaaataccatttcaaatgatgttttataaatttatattatttttataaataagttaaaaaatatattattgtgataaataattttgttttaaaattatttagataatgaactcatttagaaatactgtcattcacttcatcgtacccgactgcaaacaattaagatttgaaaaattgatgcaacctagatttgcctttccattcccatgacatcacatgcacctgactatattaaaaaaataaaattttgaaaacatcccatcaaatatgagccatttacatttagatccttaaaatttaaaatatatcaattaaatctcaaaattttaaatttgttataaaatagcctaatggccgatctccaattgaaaacattatcatacggaggtcgtctaatagcttaatttttgaaaatttcatgtctatccttcccactaattttgcttgggacttttgtttcgatgaaatttgaaaggaaagaaaagtagtactttgagatttgtatctatagatgaatgactttattctgtacgatctatataaatggatagatgaggaaaatataatattttaaatttcatacaaattgatgaatgatagaggatagagtgctttgatatccatataagcatataaataacaaggatggagtgttttgagtactttaagatctatgtagatagatgaatgataaagaattgagtattttaagatcgtgtaggttgatagatgatagaggatggagtgatttaagatgtatgtaaatagatagatgatagagaatagaatattttgagatgggtgacaaaggatgaagtacttcaaaatctgtgtagatagatcaatgatagaagatggaacgcatcaacattcatgcaaatcgatagatgatggagaataaagtgctttgagatatctgcaaaagactggatgataaagcattgagtgatttaaaatttatacaaatggatagatgatagaggattgagtactctaagatttgtgcaaacaaataaataatcgaggatatagtactttaagatttatgtaagcatatggatggtggatgatgaagtttttttaagatatatatagataaataaattataaatgaagtattttaagatctgtatagacaaatggattacagacaaaatgcttagcgatatatgtaggtaaatgaatgacaaagaataaaagtatttaagatctgtatatgcggatggatggttgaagctagagcacttcacgatctatgctcgcaaatgaatgataaaggatgcagtattttaagatttatgtaaatggatgaatgatagaaaataattttttgaaataatttttcaatcaattaaatataataaaaattattttttttataattattttttaaataaataatttttaaaaattatcagattatcctgtaatctaatatatccaaccaaacagatcttaggagaggttttgggttaggtgggttttgatatgggtatacaagtaaagaacatacgaaggagaatggattgaatagttaaatgagtggtttggggaaggcatagttgaatattttctctcttgtccgtccctgcctcccccctcctccacattctttcttcctatactagagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaaaaatttattttttgataaaaaaattctttctgcatactaaatgagtcctgaaagagatagctagttgtcagcttgtacggcaacaaacgagatgtggcttgatctccactcagaaataacatgagggttacgtagtatgcgctataaaatgtgcactcaaacttttttcctctaaaaaaaagtgcagatggtaaccaatttaccatcattgtccgaacccaacactcgatattctttattgaaataaattaaccagattcctattcaaatctattcaaggaataaaaataaacaaacaagcatggaacagtcctcatgccatgtcatgtcttaaaagcaaataagcgatttagcaccgaagttatggccgacatatatggaacaactaaagcagacagcaatgagtagccaatcttgaccaaaaagcaaagcccagtctatcactttgggcaatacgtggccacaaactctgcaatgttcctatccgagcttccaccctcccccactgcccttttggtcaactcccccaatttccttgcattccctctgatctcttcactcctctccccctccatcaccaccctcacacacctctccaactcctcccttcccaccaatcccttctctccagctctcgcccgtaccccgatcttccaaacatcctcgatatatttggcattcattggttgatccgtccactgaggcattccgaccattggtacacccaaactaatcccctccatagttgaattccatccacagtgcgtcaggaaacagccgaccgcattgtgggatagcaccgctatctgtgggctccatgaaactaccaaccctcgctccgaggacaaattcttcatgaagttctctgggagcttagaggtttccgaggatctcaccacccaaaggaagtatttgtcgctattgagaagaccgaatgcaagctcagccatttggtcggggccaagcataactatgctgccgaaggacacatagacaacagagttagagggttgggagttgagccactgcatgcagagagtgacgctcggggtgtacaagtcgaagccatagcgagagtcggatgggagccggttgtccaagtatgaagatggcacagtagggcctatggtcttacctcgccatatcgatgccatatagtcagcttcctgcttaaatttccgacaagaaggacggctaaaatttctttctaatttcaaaactaaaaatttaaaaaatagaattaattttgcggctatatcttaagttttaatattgtagctattgccacaccccatatgaggttggagaattcagaattatatgtagtttttatttcctctgttgaaattaattttcctcatttcaatgaatttgattttactgtttgattctagctaatccattctgccaataaaatgatgagaaatgatcttcttaagagaataatgagaaatgctcacttatctcaaaaagaactaagcataacttcaaagcttagctaccacctgcaaattactgatttgaaattgatttggcatgatagtggctctattgcgatatgttaaataggattgcataaaagcaggaactaataaaaattccacaagaataatgtacacaaaccatgatggtgagatgtaactatacagctcaataaccagagccgacattgacatcgatatcggcaaaccatttgctaattgcaatcgtggatgataggaagaattaatgaaactaaaaataagtcattcatgtagggaaaatgtatggctaaggctaccttcgacaaccatatcagtaaatacattacacataccatttgtgaccacattggtaatcaaactaagtcttttagtgggtaataaatggaattatggcaaagagagacaagtacaaaatattccaagctgtcacaagtctatagccaatgcaaaattgagcaaccacaaaaaaatagccattgcagatctaaaaatcaaaatttactaactatggaagcatgttcatttcaagagaaccaccgaaaagtccaacatcatcataaataaaggaaatagcatgaaatgggagtgcaagaatccacaattgctacaaactgagctataatagaattggctcgactctaagatacttctagtcagaacttttgggaaactaattttagttgcagatatgatttttgctggcaacaaattgtttggttgtcatctagcaagtatctttggtggagacaaactagatatagaatattgttgggtgaaggtatgactattcctagtcagaaacaacacaattcatgggatgcatgctagaatttttttttttttttctttaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagtaacaatatggtttgatgagggacaaaaatctaaccatcttcataatttaacgcagagtcggcccataatcttgcatcaagacccacgagagaacaacatttggcatcgatgattcttgttttacttagatctcaatgtgagatgtagttctagcaatgatttgataagcattgaatccaactcatttcttttttcctttttggtataaaatgggcggtcacaccaatctgatgcgagagcagaccaaacaatcaagatctacaaaatttcgcagggtctgcaggcaatcatcactaggcctctatagccagtcatcggaatggtcaacaataaaagttgccactcaatctgctgcagtgttcgcttttcggaaaacatgccggactcgcaccacaacaacttgacgaaggataatacagatctcccggatgagcggatgaacctcgaactatgtggtgcctccctgaatccaaaagataacaatagcagagtcaccctctagaaaaatttgtttcgtatgaagctgctgcctggcaaagatgacacctgcctaagctgcatgaagctccgctattggaactgaaggctcaaaaaagtgagatccaccagccaccaaaagtctaccgtttgggtcatggataacaaagcccacactatccctcccacttcggatactaccatcaaagtttaccttgacaaacctcggaggtgggggctcccaaaaaatggatagaatcctacggatcgctgttggggcagctagggagctccagagtttgggtgtgtcttgggatgggttggtaatgtcaaagtggcagtacttctgagctaaacaaactgctctctcaagaacccaacgagcaggaatcatatcactatcaaacataaggctgttttgagacacccaaacctggtaagcaatataaaccatccacccaccacccatagctgtctgatcaaccacactctaacggatcaagccaaagatagaaatcaactaagggttagtacgtacttgcctcctatgaaaaactgcccgtctgtctccaaataatctttgccctagggcatcgcaggatagtatgcttcacagactcatactccatgtcacagatcggatacactggctgaacctccatgcccctctccctgagaagtgtttgagtaaagagacagtcctaggcaaattttcagagaaaaatctgaaccctcggatgagcgacaactctccaaatttaggcagcctcaatccgtctagagagcatcgggctgtataatcgggaaaggtccctcaatggaaccctcaagcagcagaaaagtccttagaccctcacattctgtgtgaggtgtacaaaaatcaggatggcaaggatcctctccgccagtggctgcccaaagagttgagtgatcttttatactctcagctgaaagtatcaacagcaatgagatcagacatcctcatgtgatcctccacctcgatgctgacaagagttggccaatgagataaaggaatgctcaaaatccaagcatcctggatcacccccattgaacgactatcacccaccaagtatcggatctggtccatgacatcaggcccctgagcacaaatctcacgccaaatgaaagagcagccccggacaggctagatggtagtcccatggctccacctaccatagtgagctctcatcaccatgctccataagcaatctaactggatcagaaatctgactgtatgtctggtaagcagagcctccctcttcatcaataaataatggatccttagaccatcatcctgcacaggctgacacaccacctcccaagacagtagatggacccgacgacggtcacagctagatccccacaagaaattgcgaaactgctgctctagccttctgacacaagccacggggataactgtgtgggctaataaatagatcaaaatagagctcaacactgatctcaccaaagttgtcttgcctatgaaggagagggtggtggcctaccatccttaaatatgctcctgaatccactgctccagcggtctacactcagctcaccataaatgataccctgtgatcgaaaccccaatataggtcagcgacccagactactccagaatctccaggatctgcttgatcatcaatctatcatggaccttcgtcctcgggttaaagatgacagcagacttttgaatgttaaccaactgccctgacatctggcagtaggccctgacaatggatacgaagtgctccgcatttcggataaaagcatgcctaatgaggaggcagtcgtctgcaaaaagaatgtgcgaaagcggatggacatctggggtaagccagtatggctccaaggcctgaccctgaaccatagctcacaacaccctgaataatacatcagcaaacaaaatgaacaggtaggaagagagaggacaaccttggtggaggcccatagaagagacaaaaaactctgtcggggtgccgttgacgagaatggcgaagctcgggtactcgatgcagtccaggactcaatgaatccacccctcatcgaagttgagcttttgaagtgtctgtcgaagaaaagcccaactaatttgatcatatgtccactctatgtccaacttgatggccatgagactatgatgacatggagctcattggaggtcgtgtatgaactcctgggccaacaaaatattattggtgatagaccgtcctacaacaaaagcaccctgctctggactgatcaagcgaggcatcagtggcttcagccgcttaaccaaaatctttgcacacactttgtagagggtcatgcagaggctaatagatctgaaatgctcagaaagcatagcatccagtcgcttcggaatgagagtgatagggatttgctttcaagcctttggaatgcccctaaagtcaaaggccacctgcaccacatccactacctcctcccgaatgatcgaccactaccgacaaaagaagagaggaggataaccatcaagcctccaaggtcttgtcctctccaagatatcagagggcctcacgcacctcgttattcaaaatcctattctcctacgcagtaatacagaccactggctgagcacccagaatggaacagtcctcacccagcgacctcgtccaccggtctctgaagaaatgaaagatctcctctcggatccctccactatcagccacaacaccaccatcactcctctgcagctgcttgatgtgattggtggactttcgaatcatgatggactgatagaaaaatctgaagtttcgatctcccttccgcatctactgaaccctggacctttgcctctagtaaatctcttgctgcctcaggagagagtaatgctcagagagcttacctcgtagctcccccaactcatgctcaggtaagccacctccccggtcctcctaaagctacagctcctcaatatcagcctcaacccactcaatctatcgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgattttcctttacctatttatataagtttttatagtcttcctgaggccataaaattactttgttaaattttgtgcaacagcataaaccagtcaaaattttacattagatctaaaatcaacctaaggttaagttctgagaaaaaaatttgttgatatatcaaatactagaagctaaagagaaaagaaagagttcatcatgattttgagtttttttttttttaaagaaaaagaaagatgcccacccatctacttcattgagacaatgtaaggggatacagctctctcctcagaggaggagagggatatagaaaagatacaaaacggaaaggaaaatgaataagagggaggtggtgaatcattaaatttttatcaaaaatttggcagaaaatgtagtcgaaatctttcattgtgtatacatctgtatagtccatcttcctctgtattttttgggcaaagtggtacatggaaaactctgattatttcttagcaaataaaaattctacatcgagtaactctttgactttatctcttaaattagatcaagtgattcaaataatagtgaagccatgtatatttaccatcttttactgatgaaacatgcatacttacaggctattttagcaaggagagccttctgagcatgtgtctatatggtttactgcattcagattatatctcttcataaagtttctacaatgcaaaacttgttttcaggtgatcaattggatggcaaattacatgccaatgaaagcgattggaccaatggtcccatctacatgcataaatgaacacttggatggagacaaaaattatggtgtagacctatggaaagcaaacggtggagtctgtatgaactggcttgataaaagagaacctcagtcggttgtgtacgtatcctttggaagcatttcaaaagtagggtcagagcaaatggaggaattggcatgggggttgagcaagagcagctactactttttgttggtagtgcgaacagtggaggaggataaacttccaaccaaatttatggaagagacaaaggagaaaggattggtagtgccatggtgcccacaaccagaggtattagcccataaggcaattggatgttttgtgacgcattgtgggtggaattcaaccttggaagcaataagcctcagcgtgcccatggtggcggtgccgcaatggaccgaccaaccgacgaatgccaaatgtgtggaggatatttggagagtgggagtgcgagcaagagtagatgagagtgggattgtgagaagggatgagatagaaggatgcataaagatggtgatggaaggggaaaaggcaatagaaatcaatgggaatgcaaggaagtggagggagctggctgtgaaggcattgatggaagatggaccttctaacaagaacatcaatgattttgtagctagagtagcaactaaaaaggacctgaagaccataactttagcttcatgaaaattttcagattgaatgataagtaacaacacctatcatttccatgtaacatgaagtttatgatgacttgttggaagctgcttgtcatcagaaaagggcatttctgcaagctccatattttgccaataggtattcctttaaattcttaacattgcgtagttttctaacagtcagcaggatgagtcatcttgagagtgtttagatgagatgcctcattggagataaaatgtttccaatcattcagaattaatgtgtaaaggaaagctgaggggtttcaggttctgcatgatcggtgcttagtgtgatgcgaacaccttcaatattagcattttttttgttttaatttttgtgcaccaattattaccgtattatcacctctggaagaaatctatccggctatcagaacaataatctaaggcagagagatggttaccaaccagctgagctaccaccttttggccataatgaatgactttcttatttcaacgagaataagaagaagaagaagaagaatataatgaatgtctttcagcaccttggtggaatctgaaccatcagatattaactgcttgggtgggatgatcaagctcagcctctgattcacataccattaacctgatgttctcctgttttagaataaacaatctgtgcttgttcgtcttttttgatgattaaaaagaagaaaggacaaggataagcacagattgtttcttgtagaactggagaacctcagcttgttcttgtcttgttcttgttgaatcctcatcttgttcaacggagcaccctacgtttggtcgaaaaatggacactcaatggtgctaattctgctatactatgttccgggtctggcattatgatatttcccttgctgtaaccctttttttttgcttttgaaaagtgaaaggagtgaggcactcctcccatggatttgaataaggtatgagcgaagtaccagaccttccctgaccaaaaagatgtaaagcaatagctatgtgttcttgaaaaggacacagtgcattgtcttttggtttacaggggaaagcacaacttcatcagagaaaggctctctcttgctgtaacttggattgcaccataaaccccttcacatctctggagccttggcaatgagcctatgaatgcaatactacactacgatgaaaatggtcattaacgacgctattaaggttattttacgacgctaataaacgtcgtcaatattctttacgatgcttcaaaaagcgtcgcctatgtaagagtggagacggaaagcaccgacgctttttaaaagcgtcgttattttggtaacgacgctttaaagcatcgtaaaattaacttttaacggcgctttttagcgtcgttaatgacaacgcatccgccactctaccaagacgctttttgaagcgtcggctgttaggttttttgcgacgcttataagcgtcgttaagtttgttttaacgacgcttttaagcgtcgttaaatgcatttctaacgacgctttaaagcatcgttaaaaccatatttaatggtactttttagcgtcgttaatgactctgcgacccgcactctaccaagacgcttttcaaagcgtcgacttttttgtctttaacgacgcttataagcgtcgttaaaggttttaagagaaaaaaaaaatataggttttatattccaaaaaaaaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtcgatattttctttatttaacgacgcttttgctaaaagcgtcggcgttgacagtttcaaatattacgatgcttttaagcgtcgttaacaaacgacgctttttaaaagcgtcggcaggtcagcaacctgccgacgctttccaaaagcgtcggcaaaaaaaaggccgataatttaatatttttttatagtgctagtacatttcctaggctttgaaaatgtggagaacccacttcacattgttcagcgagttggacacaactcacctatcgaagtgacatcatcctgaatcattcttcctaatgaataattaggtaagatctttgggtcccattaaaagaatcactgactgtataaaagccataaaataagcatggcgaaatcctcttctcaagacactacacttgttaaccaaggcaaagttttggtctaccatgtaatgtgtctttgttgtactcaaccaaggcatctaagttttctaggtggagtcaggttgctgcatttgcttatgcggccagacatgatggcgtttggcaccataattccgttcagacgtttggcttttctcaatagctttggtagccaacagccatgcacagaaagttgctatctgtactgccaagtccccaaaccatgaagtcataattcaggaaacattttttcttggaggagcagtattgttggtgtgactcaaaaatctcactagttccaccttcccatctttcgatcgctttataaaccccctaagaaaaacgcatcagtttagcaacatcttcaagtatttgagctacctacaatcaaattgactatttaatttcatcactccaccaacattgaccaaggtataaaggtttctgatgcatgtgtcaaatattttagtgctggattactattttgtccatttgggaagttgttcattctagatgctctctctctctctctctctcttccctaaggagctacgcagcttatttaccatgactttaatatgtcccatagaaatttgaaggttaaatgtgccttggagtcaaggtagaggacattctgagcatgatcagcctccccattagccacatacctaccaagtttagttcccctctatttaggattaaactggagaggtccatttcccaatccccagcttctatgcagtgaggaacaactagtgattgagtggtaacttggtagccctgttcaatcactagtcattctgcaagacacagagggctagtgattatgtatcagatctctctagttcaatgtgaaacttgatagatttccaactctcatctatcaaaagtggtcgtcaatttccagatgacctcaatgatttctgggagcatccagtgtttctcttatcatattgagtgaagtggatcttctaagcttaaaaaatgaccttagagtcttactttctcaataattgctctttagatgatacctccatgccatgtccctgtttgcaagtaattggcatggcgtacaatgcagagaccttagcatacaccaacctgatatttgtactggattgatgccacactatcttttctgtattagaattggtttattctaagcaaattttcatcgttaaatttcattgatttatattcttaatttcttaaaaaatatattgctattgagttttattggagaaactcttaaaaaaactgcatattctggaaaaaagagaatgcactggaaggcaaaatgtagacttgtaaagtatcaagcttagatgataacaagtgtcaccatataaatgtttttgagggaaaaacatcagtataatacagcactgattttgctaaattatgatcacaactaactatatatatatacacatcctctttttataatagttgcactcatttaatgcctctccctccttgtgtcccaccatggcatacaaatcactaatttatatccaaatctaattccaaagtttaatttcttacaaaatctcaaaaattagctaaatactttccgttaaaaaaatgctgatttgttatcaaaaaaacccttcttgcctagatgagcaactcaccttgagggcatgcctctttatcacatgatttccaaactcatagatgcaatgctctaaaccaagaggtctgtcgacttgatttccatatctcattttagtaaacaaaacaaatccatattaaaaaaaaaaaaagcccagcattagcatactatatattaggtatttagcagttaaccaccattctaattataagaagttagcttaagcgagcagcaggaatgctagagagcaataatttacacaacaatattggacgcacaaaatttagggatcgactgacatcataatcacaattcacaatgttcggtggcccccactaaacttcccttcaaaactggacaaggaactttcactagcgtggggcttggtttcattgggggcccacacgtatggtgggatgcggtgggcacagcttgtgtcattctctcgcaggcagatcccggacccggttccttccgtcccacgaccgatcgcccgtgccgtggctttatctccttacgtgtcgctctccgattccttcgtctgctcttcagtacacgtgaaggtcggccgtttcccacccggccgcccgcttgtcttctactgccattttctccaccgcttactttatggcaaaaaaccgaagcctgagctcccctgctctcttcgtctctctctggttcttgttttttttcctcctcttctttttttcttgcttctccctttcgcgtcaatagaatcttctaccgcaacgagttctggcaaggaaaatattctcgcatatgatcgaggtaagtcggttttgatgggaaggatcgaggttttgatacgattttagaggtttttgttagaggtgttgacttttttgctggttctgaactggaagaagcttattgttgcaggatttgagtgatcatggagacaaaagttgcttttatttttgacgtatagattgctatttgttgcatatcttgttcaattttgctattcgagagagatctgagatgatatggtcttgtatatgatcttccgatcattgaggtcttgtgattttgatagatgtggatagaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagactcaactagaggcagctagtacccaatttctagtgacttaccaactcagttgtttggcatgttcaaagctcagaaacttcttacctgggattctttcgctgaatatttatcaagccatcacccattcaaggcatggacaacggactcatttatttgttatggttgtgcaatttgttatggtgataaaaacatgatctaattgaattggcattagacactaggactcaattgggtgatttgttgggtaagagtttataaaaagttatatagttgaagatgtattgatctttctttcagtttccaatgcagctatgaaccggatgcagtgaagaaatttgttcttcacttgcttgtcatgtcacacacattttcagtcccttcactgaaaagggcttgcatcaaagaactggaaacaacattgctgaccttggagaatgtggttgatgtgcttcagttagccagacagtgtgattcaccgcgcctttcccttttatgtactcatttgatcattaaagagttcaagaccatctcagtgtcagacgggtggaaagtaatgaagcaagccaacccctgtctcgagcaggagcttctcgagactctggtggaggcagattctgtaagttcagttcttctcgggttacaacttgcaaggttctattacaactatttatctaatgtttgcttacttttcagacatgttatgtgaaatttgcagtagcactgagttttattttctattgcaaaccataattatttttcctattgcatgtatcactagaaacacccttttgttgatttggtatgtaccacaatgcagaactacagtagcccaatccttgtaaatttgctgcagagagcagtttgaaactcaggattttctacataactgaacagtgtgggtaatgtaacatgcttgttcaatacatgcgtccatacttattaccattgtgtcttttctgattaactaacttttaccttttttttcatcttgttttttttccttcctttttttcttttttcttttgaaaaaaagcagcctacaattcaaaccctcaagagtacctaaattggctgtgtgttcaagatgctttatgatctacaaatattaatctgctaacatatttgtgttccttctttttttgctcccaaaattttggaactaattatattctgtgagagggaatgagtgataggtacaatcctaaatttgcatatctgcatctatggacacatgttaagaggcaataacttacatcatctatcccttattcctcgttctaatttttattgttgtacatgtagtcattggacctgatcgacatcagtcttggcactgatgcagaaaaagcaggaaagggcaaaaaagatggaagaaagaaaggtgtacatgcagctgtttgaagcaatggaagctcttttgcacatctgcagagatgggtgtcggtccattggtccttgtgacaagatgctcaaagacaaccaagctgcttgcaacttctcagcttgcaagggactggagttactggtccgccatttctcagtttgcaagactcgtgtcccaggtggttgtgcacattgcaaacggatgtggcagcttcttgagcttcattcctgcatgtgttctgaaacacactcttgcaaggtccccttgtgcaggtttgtcattcattagcttgctttgataacaaattggcatcaactagatgctctttgctgcaagtttaatgctttcttcctgtgattttgaagactttcaccttccactgttgcaggcatttcaaggataagatgcagcacataagcaagaaggaagaactgaaatggaacctgttggtcagcaaagtgatggcagcgaaaggaactattagctccatctctgcccggagaaacttggtaatataaaactccattgtgagcaacagaggggatcagaagtgtatcttaacgaataagtgctatgagtaccgtccatgtatctatgttaaaataagcattgcctgtactcatctaggttgccaaagcttgttgcaccgtgacggtgccaccgtatgtaaagaaattatatcacgacctatgcagaacttgagagtaaatttcagtgctaaattatcatatgtcattctatccatcttttccctggggtggtcatgcatggatcttgtattctggtgactgtaacaatatggtggaattgaacaaaattttgtatcactgtacattttgtgccttctcctataaataatatgaactcatgttctttggatgtgtcatggtcttattaattctattggtgaagagaattgggcatctcttaatttgatggtggttgcatgaattttgtagcttgaggattgagttgggagagaacagattagggttatcacgaccatggttatgaatcgcttttgtgctggcttcaaatcaatgattgtttggcttgaacctataggttgtttcatccatgctcatcaaagtctttctcgattgagaatgttccattttcctagacaggtaaccccagagaatatcaattggtgagcaaaaatgaggtaacaacatcctgctactctgcattttgagtttctacaattggctcaaatttactgtctggtttcatatttttagatatttagcattcagtctaaagaaacacaaacattccggctggtgtttgtaggatgatagatcaacaaaagcatgtgtggaagtcatgggagtggcaagaacggccagtagaggagtgtaagaaggcagcgagggatcttaagcggaccccttttgaatgcaagcatgtgagccttcctctgaactcctaggcttggttctttgaacaagcgtccttcgatgggataactgcaggtgaggcccaaacaactagacgggttggtgccatggcaaatgatgaaggttgggtagaggatttattttggtccaattcgtatggatcgaaaatataaatcggggggaagcactagtgcacaatcaatttgggtcaaattaagttgaccatctttttttttttttttaaatcctacaatcaaaagtagatcagaagacccgacttgcagctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactagccatccaaaaaaaaaaactcaaaagtattctgtatttatgtgggtctggattcaaccccgtcttagccgtctatgattttgtatgggtacgtgaattaaggcttattgacttgttgtccaaaccaatccgccggaattaccggctatgcatggggagatcaaaaagtatcgggaatccattcttaacacctaaaaaaatttaaaacaatggtgtcgagcttgcgtgggaaaaataccagaaaaggaaacccaccaccattcccgtcattagtagtagttgccattgcccgcgattacactgacactttgactcttcttgttctttctctcttttttttttattttggctcccatcctctcgttttcagagcagaaaatacgagtcttaaatcactccctgacgcactgttctaatctcatttatcatcaggaaaagacaaacaaaaaggaaaattaggcaacaacaaagaaggggaacggagccaggtaagacaccatcaataagtaacttgaagccaggtaggacaccatcaataatcagcttgaagccaggtgagacaccatctataggttctagttacttaaagaagtatagatcatatgtcaccaaaaaagaaaaaaaagtatagatcatatttaatttgaatatcttaattattaattttgaacttggtgtcatcattttgtctttcttcctttcatctgatggttcccagctatgccatccagagactcactccctgttcgtactccatttaactcacccggcgttccagtttgtcacccagttgccattttactcaagtacgagggtattcttggaaccaaacgaaatccttcacacgtttacctatcgtggcatcgtcatattgtatccaaacgttatcctaaggttttattttctaaattgacaaaactatccccactaccgaacaaaatctaacacagcacgagagattttaccatcccacatcgcggtatcgcggagccccaaaattggacggtggccattagatctccacggcatgagagcaacgtgatgagaaacgaacggttggatgtgggtgagacagaatggagggccgacctgaaagtcgaaaatatgtacttcttttttcccctcaaaaaaaaatctcgccttttttcttttttctaattctctttgttcctctttctcccccactcccgtcttcccctcgagttcaattcttccgacctcgagctgtacggatctctcgtttcatcattcgaattccaccattttagggtgtataggcggttctaaatcgagattagggtttcgggcgtctggaattttggtgggttctccggccgccgccgccgcctctcgatgggatctggttttctggagctggcgcttgattctgtcagtggagttgttgaaaggcggcatttttggtagcctgggcgctgagtgagttgggcttggaaagtttggatcttgggtcttgtttcagtgggaaatttggaagttagggttttggggtggttgatttggggcaagttttggtggaggaggggtgtcaggggtttggatgggcttctagggttttcggtggtgctgagaaaggagtaagatgttctactcgcagtttattttggccaagaaagggccacttggaacgatatggatcgcagctcacctggagcggaagctgagaaagaatcaggtcgcggatactgatattggtgtctcagtaggttggtatcctgtaattcatcagctattctaaccttctccttcttcgccttcttgtttgttgtgttcgtcgttttcttgccctgttacagtttattcgcagagtaacccccattgtcatatatcccacatgagcttagtatgctaaagctttgattaaatgcatttctttttagcatctgctttcaaaatgccagtcttttggaattgtaaatttgatgtacctgcggcttagatgtgtcaaacttttaatttgatcactgtgctcaggtgtgtcaaattttcaatttgatcacagcagcatttttggtttttggctataatacgatttgaccatgctttccccatagagtttggttctagtgattcaatgaatttaactattggtgtaaaattttctccatatttaatattatgtaaattttttcttttccatctatccatcataggactatagctgagcgaaagtttttacaattgcatctgttgctatccatgtctgatttatgaagctctaccacttgtacttaatgttctgtacacagggcttcctccaatcctctttacctttccttctgagcctctcactccgaggttcgctgaactggtactggatagcataccagctagcgattggtttagcatggcatggttttgtaccatgctgttctggggtgtagcaacaaaggaagagctggaagaggggggggggtgtgtgcgcgcttggaagccctaatcaaaacaggatcctctatttcattttgattagggcttttgagcctggagagctctctctcaacttccctcccctcctcttcctcccccgctcgctccctcacatcctccctctccctccgattgaggccatgaactaataactgaccagtctggtttggtccgattcaaaccaaggccatgaactaataactgaccagtctggtttggtacacctcaaaccaaccggttcggcacagttcagtgaacgttatttcactccctttctcctcttcacacaatgattgattgcgaccctcttccttaaagtaatcatattaaaattttctgcacactatcagaaggttctccatcaatttatctccgattggatttcctattagttccttgttctctctaattttgtttgtcctagttttaggatctttttgtttattttgattggtgaggatggggcatgatggggtcttttttttttttttggtgggagagggggggggggtaggttattgtactgagctgagtaaataggaggagtctttaggtgaatgactggagttagggtttattgtatatattaatatctttcaatcaattgacttcaaattgcttcaaacatctaataagcattatcacactgatgttatttgaatttggaaaggttaatttgttttacatattcataatttgagactgcttatttattggttcacccaaaagtatgattatgtgactaagaactgattgttcattttgttttaaagaaggctttgcatatgtaaagtatattaatattgtgttgtatgataaatatcttactgtatgttaacctttatcaaagcaaactcctaaggggataaaagacataataccaaaatgtctcgaaaatgagacatagatactgtttgacttgataaacctgaactggattaatccaaacctttgtatttcacattgtttattaaaatctttatgagtcttgccttgtctcttagtttgaggtgaggctgttcaaacatgcctaggggctttggggtgatgctatgtacattgagacttgaacatcacatggagaagcccatgtgagatgatgacttgcacattaattgatttctttcatgtacatattattatttattatttccatttcttgtggaatgagatagagatccttttttaattttttaattgatattctttgtggcataaacatttaaaccatggttgtgagatatgatgtgtggtggatcatgcattctaagctttacatgaaaatcttggcaattttgaactaaagtaggccaatttttttttttttttgtatgttatcttcaagattttaacaattagagtaatgtgcaaaaagtcatgtagtgggccagtgcaagcatgatatcatgttccaagtgttactttatcacatgatcttcttatttttcaaacattccttttaatatataaagcaaaccttgagagtttttgtcttatgctttgagatggacatcaaatcttctggagcctatatgcatcatctgaggtttccacctgttacatatttcatttaagtgattagaaaggaacttttttcccaaaatcagaactattagtcatcaatttaaggagaaaattgcctaagctcaatatgatgtaggatagactacaatattgagaccgaataaagattcgatccacaaaagtagttttttgtctgttgtgagttgtgattgtaaattaccgtcttccttttttcgaagtaataaaaagcattcaaaaagtgaaaaaagtttagcacatttatgaatcaataccgagattatagtaatattgaagtggtcaaagtccttaaattagtaagtttgaattgaacacttcaaatttgttcaaaatttttgaattttttttttctgtttgagctaatgaatgatcaatagttacggtaaactatcaattaatttatagatttataaatatgttaatgatgccacacaatgatctgatggtggttggtaaaaacaataaataatgttttctaaaataagagtctgcttcaattaaatttgaaaggttgctgttttattgtgcttctgctatgtgcattggatgtcatataggaattgtggccacagatggctgtaagttgcttacatttcagtagcataggtgcggagtagaagttctgatttgcaaagcatgatagcctaattctgattatcggaacccaaccggtaggccttgtgccaagtgtcgatatggtatatcttttggaaattggttccctgttggtacggcatgtcccatattagatagtatggtctggtacctaaagcatttgcttctgcatgtttcatgattatgcccatgaatgcatcattctatcatttaagcacacatgtttttgttaaatttttgaaaaataaaaatataaagtaataaaactttgttttatttgtttagccttgatattagtgtatgccattgctagagatatgttcttgtcacaagttttgatattgtttcatttagtaaggtttttgatcatttctatcagcaaatatgctttatgctatggtacctagactctctatttttaagctatgtaggagtgtcaacgcttttaaatacttggacatggcataacatgatgtggctagatacttcactttgaagtgtcctgttaatatcatccaaaaatgttggacatttaacatatcttttttcccagtggaatgtaggggaactcttagttttaagtgctggataccttcaatttgaatataaagttttcaaggttttgtaggcactccaagcaaagtgtctttatgctattatataaagttttcaaaattttatggacactttaaacaaagtattattatattttttatataaagttataagaattaaaattatagtttaaaatgccatggttaattattgtgttaaagtatctcaacacatcttaagtgactttaaaggtacctagtgaataaatatacaacttgcaaaatcatggatattcatttatttgcttgttagatagcatctacaactctccttcccctttctctgtttctttttttttttttggtgaataagcatcaaatgatacaaacacatgtttgtacgacacacacacacacacacacacacacacacgtatataacatagtatataacatatatatatatatgtctatacacgtgtatatatgcatacataaatgcatgaatatgcatatgatttatatgtgtacatctgttctgtccccatgcctagattttttaaggctaccatgtctagcattggaagacacaaataggtgtctaggtcaaggtccatattggttggtgctgtactggttgatatcttaccatgctgacacttagtacgccgagccttaccgtaccatatggtgtaccgacatcgtaacaggatggtactgagacagtgaaccttggtgtaggtaacattgccttgtgtctttttttttcttatggatacaaacatatagatgcagctttacattgatcacatgaatctttgacgatattacacatcctaaaaaggcaattttctcactaggaggatttcacagatgtgctaatataattccatacatttgtgatattgttatgttattctaaacgtgaaaaactatcctgcaagcacaaactgaataaccaaagacaaataactcgttgttgcccatcatgccctaaattagaagccatgctaaagaacctgggaactacgagaacatgattggggtgttctagatgctaaaaagcagggaaaattaagactaagaagagggacgtatcctatgttaataggcatccaattgtttaggaactttctttgtgctcctaggatggtgagccacttctttatggtgtatctgaagctagtgaactggtctgtacatctgtgggcttgcttgagtttatgcttgagttatggatgtgagaagactaatgtgatcttttttagtgcaacatcagccctaactctctgtttggtataaagaatggattgaatgaaggatggatggaggaggaaggatggatggattttctatagatcctctcatatatttggtgagatatagaaggatggacggaaatgatttcctcctttgtttggtataggaaaaatgaggagaagaatagatgatatttttataatatttttactaaactattctttgataaaaatattattattatccatttataatacttatttatactaaaaaagtaaacaacgtataaacttataatctttataatctataattatataaaaaaattatataaatattaatttaatacatgattttatagattaattattaatgaattaattatataaataaataattaatttataatttagttaattaatattatacaaatagttaatgaaaatagtaaatataaatacagaaatagaagataatctaattatttaattataattatgaaaagtatatactaaaattaaaataatgactcataaaatttaatagtataaataaaaatatatataaataatatgaataaaaaagtgaagaagtattatagttttatcaaaaaaattaatgaggggtgattttgtcaatgcaaaagtccatccttcaatgcttcatccatccttcatccttccaatttgggaggatgcaaattggtggaccagggtggatgggcaatgccttctttttcatccattcgtcctattatttattgaaccaaatggtggatggaggtcatctatccttccaatttcatccataaattttctaatgactccaacaaaacataaggtaattttcaccgtaagaaacgaagatcaggtaaggaggagacaatagattatgttaaactgggagagctacattgttgatttaaactaaagctaaagataatatttttaaaggggaactaatgcatgggtacacttgatggtgatgcccatcactttttaaagtaattagtgacttctccaaaatagaagcccattaactaaaacaactaattaaatacttcgatggttgtcttttggattcatttaacaatgggagtggcataggggaatcttaaagtgacctgatactagggattcaagagatatttcaaaaaaggaaactctttaccattggcatatatgttaatttaacaacatataatctcccttttgtgcatcgcacatgagggggcttttgctcttatctattatttcaattctttgctttattactactggtttttattctcaaatatattttctattttttctctttcttttggggagggctgaaaatgggttggatattatatgatcaaatctgtttctgtatctagttcggatcagatttgaatagagatccttatatccgatagaatgctaatatggatccggatatatacttacaattttgctggatatccgatatggatatggatattaagttatttttcagatttggatttgaatatagatattaaggtttttttggatccagatgcagatagggattttaaggtttgtgatagcattgacttttaatatatagttatggtttattaaatttattcaaaacttagtcacattataaaacatggtcctttcaaatatatgtgatattcatattttaataattatttttataaaaaaatcaatgctttttttttgatagggtgaaagactcatagaacacgggtatgaatacaatccaaaatgttagaaaaaaatgtcccttggaatgaaggcaaaacagaagcatcagtccagatggtccctcctgagtgctgggcaacatggctagctacctagttggtagcactgttcgcctctcggtatatttgtttaatgtcgacagtgttgcatcctcttaggagcctccaactgtcatggatgagagggtgttgagccgctccactagtttggctccacatccagcctaccactgtggtagaattctcctcaatcatcaatcaattggcccttaggaccccttgcatgcgtgatgccccccaggcctcccgcagctctgctctaggcacggtggtctcaaaaagatgggtcccactagccacaatcaatctagaatctggatctcggatcatgaacctggctctgccattgcttccaataacactaccgtcgaagttgacctttagaaatctgggggatgggggctcccaagtgagaaaactcatcgagacactacatgagcgtgaggggggtcctagatgtcccaagttataaagatcgaatcagtggatgataggtcaatgatctctactgtttggatcatggccatctccaatacaaatcttgctggctgccatcttgcctaaaaaatgtcgttgttccgagttagccagatatggtagacaatgtaagcaatcttgatactggctgacccagaatccttggccatcgtacactattgtaatacctctatgaaatcctgtattgtccctattgactggagcaccctaggaagaatagtggacagccgctagatgtgcgtagctctcaaacaagaaaataatgtatgttctatcgtctcatcctccagaccacaactaggttaggatgtcgggatgtccatccccaagccctcagcaacaccctcgtaggacgatggctccgggcaaccttctagagaagcagacgcacactagggtgaatctcgagcctccagatccaagcaccatccaatctcttggttagctcgcacttgtataagtcatacaactctctagctgctacccttggtatgcatgaagaccaccatatcttggtgccagggccactgtggacagggatcgcttgggatagaactcgctcagccaactggcctccaaagtaatgatcaccaatgccacatcccatcctctctcctccacttggtgatggtcccgaacttgcattgtctcatcaacctcaatactaacaaaggtcagacaccagcacagcggaaggtcaactactcacgagtctcgggtgatgttgatcgagagcccatcccccacccaccaagaagtcagggccaacacctcaagggcacaggagtagatcgcttttcacatgaaggaacaccgccggttggccttaatatcctctacagtagtttaggattcatatttggcacgcatcatcgtactccaggggttgctaagttggagcaagaatctcataacatgccaagcgatcagagccttgtgctgaaccactaggatctttatgcctagctctcccttattgatcggctgacaaataaccttccatgctagaagatgtaccccatttcctccatggtgcgaaccacataggaagttcttgaagagttgctccagcttctagagagaggttctcgatacgacaattttggatagcagatagatggagatagagctgaggaccgacttgatcagagtcaccctagccatcattgacaaggctttggcctaccaaccatcagctctttcttttgatcaaaattagaaaaataactttatttattctttataatattttaaaaatctttttatttaaaatattcaaaaataccaataatgtcaatatattcctaatttgtatatattttgtaacatttatttaaaaatagatgattcatgattctttttatttatgctgcaattaaaaagtaataattgtatttaatatagaaaacttttaatactgttattatatatttcatttaaatcgttttacttttttatatattttaatataaatcatgtgggattggtgatttgaacccttggtcaaatcagtctctttgcaagtttaatgattacatcttagaccattgcctagttacaatgcattgcttgtaattttgatatggatttcgtatccattctttataattgtgtgatctatttagtttccattattgaattccactcgacattcaatttatatccaaataatatctaatttatatccatattcagatagagaaaatatggatataactaataccggacttgaatccatatttgtattcattaaaaaatagggatacaaatgtggatatcctagtattcgatccaaatccaatccgttttcagcctactttggaattctgttcagtctcatgttcaacaaagcaacttggtggaacaaccaacgaatatgttgacggtgacccagaatcctctttataatataatagatggcctgttttatttgatctcattatgttttccctaagtatgttctcttctcagctttgacttttatatagatgaatcacgtgcactagctgtaattgatgggccacttctcaatggtaaatatcagaacctcgattctgtttatggatcagagacatggtcatgatggataatactgattttacgcagcagaaacaaattcatgtagtggtgatctgatctccatcatgatcctatgagtaacataattcgctatatacttagtctctttgaaatttgtaaaactactgactatgactccccctaatgtgttcataaccttgtaaaagcaacttgccaagtaggaagcaagtgggccattgaactagaggatctaaaaaactagttcatactgcatttatagcttggactgaacatcatggaaccaaggttttaaatctcttaggacgagactgttccgattttttcatggaatgggatgcgccgccgtcccgtcccgtcctgatacttggaatagaggatgtcccaagatatcccaatcgggacattgggatgctagtgggacactgtatcccaacacatgggatggtatcttgtctcgatgtcctatgggacatcccgttgggacctaaatctttgcatgaaatcttgttcctacttggtttccactaatatataatttgtttcaattccatgctcttaactaatattctaaatttggcaattttgctagtaaaaggtcataatatttttttcagagacatgtaaaataaaaattttcttttgtccacattcaaatgcattgactggtgggaaactatatatgagatttggaacaggtttcaggggactctaaccttttggatcatctactttgcctcatcaatagatgatgcacctctttgacacttcatcttgaaaagatctcaactactatgaggaatgaccaacagactgattatgaggatttgatgttcatgcacctttgttttaaagttctctatccactatgttgatagagtggtgatcaagcaactagaaaatagagctgatttgacaacattgtttgttgttgactttgcatggttccaacatttttggaggttaccagcaaggttttaaatcccatgggacggtgttcctgtttctccatagggctagaattgggttcgggctggctcgaggcccattgggctgggccaactttaggtcgggcttcaagctaggcccgcaacaattttggctgggttcgggcctaaacatagggtccgtttgtctttcgggccggctcaagcatatctttggtccagcccgggctcggcttggctcgagcccaagctcgaattccagcccaatttggaggatactcgtgccgtgcttgggagaagcccttgtgctctatccaaaacccttcaatcttggatctatggagtctcttcattccccgacggcgtgctaaccctttccttcccctcccaccgccacctcgtcatgcttccatcgttgccattcctctccctctcttccggccccgcgcatgccaaagcatgtgccgggaggaccagaaccagcatctttcttccctatctcgttgccgccatggtgtgtcctttctttcctttcggcgccttggattcgatgaaaaatagaaagaaatcgatgtaggaatgactaaaattcaaattttttttgttgtttttgatattaaattgtgaaatccactcgaaaagcagtacatgttttgctttttctcacagccaaggaccgtcgaaccagaatcagagctcgtgctggccggtcggcgatacgattcagtatgggtctgtactattctgtgcggggccgaactgatagggtagagaaggggagaaggagaagaaagagaggaagagaggggggagagccagagagggcctccggcaggtgctctcaagtcccttggcgtgggctcgtcggtcgttggagacatcatggtggcagtgccatccatccggaggccttcgacggtctccagacatccagtaagactcttcccctctctctccttcccttcctccacccttaccaagctcgacaagagctcggatggcctttggcagccctctcttcctctcactctcctctcccctcctctctctcgtcctctattttcttcttcctctctttgagacagtcgctgtgttgttttgtatgctggaattggactagtttttcgttggtatggttgaagatgtttcggagaacggtgttcatagctttgaagttttcttcgagcccgagttcgaattctagcccattaggaggatactcatgtcgtgcttaagagaagcccctgtgctctatccaaagtccttcaatctcggagccatggagtcttttcgttccctataggcgtgcaaaccctcttcttcccctcccatcgccacctcgccatgctcctgccgtcgttgttctgctccctctcttctagcctcgctcgtgccaaagcacgcaccgggaggaccagaaccggcatctttcttccccaccttgttgccgccatggtgtgcccttcctttcctttccacaccttgtattcggtgaaaaatggaaagaaatagaggcagagggagggggttcaggccgggtctcgggccttaaattttaaaatattttcgaacctaagctcgccttgacgtctgaaaaaatatttcggaccgggcttgggtgggggtgtggtcctatccaatccgacctatttccagccctatttctccctggaataggatgccccactgtcccatctcatcccaatagcaatctcaatcatgcattctggttgatatcttctatcttccccccttccctttttttctttcttttttctttcttttcttctatcttcctttctttttcttctcccttactttctcttttccatttttcatcttctatcatttcattgtttcctttttttcatctttccttcatttccttttatcttttttcttttttctctcttgatggatggattttggagttccgaacccgtcctgatctcgttttctcacaggaacaagacaggacagctgggacgcccctcgtcctgctgggacgtcccctgtcctgttgggatgtaaaatgttgattactagtaaacaaccgctctttattttggattttcaatgtgttattgcctcttaatacaatttggctcactaacgtgcatcacatgctatatgtgcagtattacccccatttgttgttgaaaataaactaatctgagaggattagtagaaaagatatcatctgtatgttgtagtggatggtaatgaagcatgatcaatcacttttaagataaacttcaagaggctcgttcaactaaagtaatttttgatagctgtgtaatctaatgtttggtgtttctctatatggtcaaccactgtccaacactttgaaagggaagtccttaagaagtcactgaattgaattatgaattctttatatggaaccttgatattgtctgcctttccgtcatctttctgaccatcaaatatcttgtatttactagaaaattctgatgtcgttgtcacattgacccttagtcaactttaacaattttcatataaagattgtattgacaagggtaacaatcaatatctagtttgtcttctattggtgaccagtaaaatttcttctaccaagctacactactaatactctctctctctctctctctctctcgcggtcgccgtttccctctttctctttctcccccctttccctctctctttcccttccattttgtccatttttctgacaaatagcatgcaagtcctaacatgtctattttccaaaccatgaatcgggtaccttcaatttgtacttctatgtgatcaatgaggtggattcctatgaggtagactcctccagcattctgtctttctgaaagccttcctgtacataaacttaaaaccatagtggtgcacaacaaaaccaatataatagttgtgcctgtattattgatgcctcaacttagtttttgtatgctcatattccagaaaattattcctttttgttttttgagttccacatcaacaccatcggatgttacatatgctatagctttagagaaatatcaacatctcttatggtgtcccaaatcgcaaaaatctagtagcttctttaagctgagcaaatcacatctctgtcctgataccaactacctcactagaacccaaagaacctattggttggtgctatttccttgggaatggaatggaataatatatcttcctttcacttatgcaggattttgttagttctggaccatgcaaagctttcattaggttctttagcaattttcgctgccgtcctcttttcttctttgtgatctttgaatcaggtgaccaacatcatgtacatggatcatggaaaacaagatctactgaagatatgcattaaattagctatgaaaaactcattcaaactgttgcttgattactctttaatgcataccatgtctaaattttcatactattctttgtaaatttattcgtgattttccttatattgactaacatattgcactcttaatattttccatttcggcatgtacaattttgtgttgtcactggcaaggttctaaatactagccctaataggacatgcctttactgacatatggtacagttccagttgcacacagcagctgtatcatgtgtcactctggtggtatactgaaccctggtgccataccagcactgtgccgactggcatgccctgcacaggctggtacataaaaccatgattattagcatttggaagcttaagtaatttagtccctttgttgtctttcctctcacttttttgataatttttcaatgcagattctattcttttccctgaagttccaattgcactgcggttgtctagccatcttctgctaggtgtggtgaggatatattctcggaaggtgaattatcttttccatgactgcagtgaggctctgctgaagataaaacaggcatttcggtcaactgcagttgatctcccgccagaagaatctaccgcaccatatcactccattactcttccagagacctttcatctggatgattttgagctgcccgatagtgcatatgaggggtcagttttggattcttcctctcagagttcatgcaatatattatatcaatttctaatcatgcatttctacagtagtttgcatgtatgaatggggatgtggtggtttcattctgttgtaactgccgagctttattccttaactgcagcgactttgttgaccgccatgtcagttcgaaagagcagatcacacttcaagatactttggatggcacaggatattcgacattgcaatttggactggatggttggtgttcagttataaagcatgatgcatttaatgcaatttggttagtgatatcttgtccatgataaattaaattgtgtatgctgaatttgtttgtacagaaagatttggcgatggaaatgcttcgcagattggcttagaacttgatgaggtaaatgctaatgcatgtgtgcatgtacacatatgtgcatgtgcaggcctgtgcatagtgttcttccttgctttttgtcatgtaccatttggtggaaattcttcatttagttttttcccatgataatttatttctgattgtcaatgaatatattgtgtcagtgttattgatatgtccatttccagttgcattgattacaatttgggtaccttgaatttgtgttagcatggaagtgaagtcatgcaattgatccttaaatttcataatagatgttgaaattaaaaggtcaaaaaggtttgcaaaatagactttatagggtatatccatgagctacgtccttggttggttgaaattacatgagaattgggtgatttgaatatatcatatcttgccttcagtcattattggttaatgtggggccgcataagccttcagtcattattggttaatgctagggccgcataattgtttctgggagctatggtggcctagtaagcctcacattgtatgttttttctccctttttatatgggcatttgcaaggtatgccgtctcggtacggagacctgtactggtgccatactgttactgtgtattcacttgttctagaaacaaatgttatgaaccccaagctgatgcgcaaaacaaaaacaaaaaggaaaaaaatttctttcggtgggagagagacaaatgaagttcacctgtaaagagaaaagatggtattattattgttgtgaaatcttattttttatgtttttgatttgaccactgacaggacttattcttggacaagcatccctctcagcatgcatcaacttcactgggctcagataagtggtaaagtcttctgtttcattctttggcttcctttaatgttaataaaaatctcttttttttcggttttttagtcgatttgttccttttccctgagtctttctctgatgttctgccctcctttatgcccctaagtttgatattatttgagtaataaggattatgcaaatccttttctctcataacaattcatttttaattccagcattcagttaatggtaccttatgttgatatatcatctattgttggcaaccctaagaagcctttagggagttactacttaagtcttctagttgactgcaaggctcaacgtagcttgactgtttaataaattgccataatggagaatgtgtatttatgcacgtttacatgcatgaccaacaatgttgttttgttaaatattccaatcttccttcttcttgttatttgaacttcagaatatcaaattatactcattgcactgtattaaatttttcattccagtataccatgtaagctattccagttggaactttgccttgtgttgttaacgacaaccttaggaacatctgatggtgttgttcgtaactctaatatgttttccctcagtgctatgcatcagggccagtccttgttttctcttgctgacatggaaattgatgaaggtgaaagtgggctcaataaggataagagtgttgaaactccaaatgatttgtctgaacattctgataatcctgacaagcatgtacttccaagaaatgatggcacctcgcagtggcatgggtacaatattcaaactcctgatcttaatgaagcattttttccaagggatcatatcgaaggctccactgcaatacccagtcaaattgattttattagcactgctgatgaagttgcatccacagaattgattgaatctgctcaggctccatctactcctggtttaatggaagagacattttcagctgctgcacaggaaagtcctgttctgagtccacaaagaaaaacttcaccggtaactggtgaagaggccttgaagtctgataaacctggctcacattttgaatgtccagattcaacgactgaaagtggtcatatacaagcagtaacaatggactgtgagccggctaatattgtgccactgacctctttgcctacttcaagtgggtttgtagctgcagctgatgaacctcattcagaatgtggacagaagagtgcagataataatgtacaaaatgatatcgtttgtgatgaagtggaagatgtgatagttgccagtcagattcatgatgatggcgatgccatgcttcctgaaaatataccggaatcaagtgtgactttaactaccaaaagcacctcacgtgagggtaatgctgagccatcaattcttggtaaacaggattataaagaagatattgaccattgtcccaatagcaatgcatctgcacttaatattgatagtaattcgcaactgaatcaagccagttctctgtctgcagaagatggagttttagtagaaagcatccctgagttttctcaacaagacctgggaggctgttccggaacttcactgagaaaggaggcactttatgttactgaatcttcttttgatttgcaaggtttgtttgacaactttggatcttttttacttgctatgactgattagaaggtaaaaaagtggattttttagcttttattgcttttacaggtgaagacttcaacatagctaatgcaacaaacactgatgtcgagatgcaccagcagtcaggacatgcattattagaatctgtaccaggtgttagcaaaccaaatgaaccatcaactggccctatttcaaaagatacgcaactagatcagtttaactgttcttcaagttctgagtttcctgaacctgaaaaaatgctgttagccccagctggcaatgttgacccggctagcgaattaggacagcttactgcagaaaagggggtaatagagtctgatggaagtgtcaacaggatcagtagcctttgcggcaaaaaacgccgattaatggagagcacaccagttttgcaacatggcacttccacaaagatgtctggcaaatcacgaattagacggaacactgattacattcctgatgacgatgatttattggcatcaattttaggtacgaagttatgttgtgatgttctaaatgagatttggcatataaggatttcctatatcatgaaaggataatagccttgcatatagatacttcaatcttccttattatttgagtttaactaattgcctgattgtgccagttggaaaaaggacaccagtcttgaggatagggccgacaccgccaccccccaaagcagcttctctaaaacgccctaggttaacaaccagaccaggcatgcccaagaggaaggttttgctggatgatactacagtcttacatgctgagtatgacctgttccccaatgtttctctcttcatattcccatttaccttgcatgctgagtatgacctgttccccaatttttcttgctcttcatattcccgtttgtatgacatccatgtaccagctgttattgtaaagcctatctgaattttggggacaaaatgttctgaataatttaaaatttctctgatcaatcttcatgattttcctcagatttatctgacaattctccttttttttaatgattttatgcatgttatttggaatcgtttttggcaaaaacaatttagcaattcttgtgattcatcttgagaaaattatttcaatttgatttcccctgatggaggaaatgagtgggaaatgttaaaaagcatgaggtattagtgatatcttattcttataacaaaggaaattagaaaaatactgaaaattgagttttgaattgtctgaagttcctatctttctgacaactttctttcatgtttctatttttgcttctcatctcccacctgggggactttctggaccctcctcatttatttctttatcattttccaaatccatttctatgctttattgaaatatcctgtagttcttttggcaatcatttcatgaattattaggaacattcttttgtacaaatctgtgcatttattaagacgtttctggatttggcatcatttattgtgaatccagacaaattttaacttgctaattttttgattgacgagtattcctaggcataatttattgtgaatcctgattctaggactatggtcagaagtcatatatgttacttttccttcttttaaactcttaactgtgttgtttcaaatggtttatttattcccctttgcagtgcaatacggcaacaactgataaatgctgaagatatacgccgcatgcgtaagaaggctccatgtactcgtcctgaaatttggatgattgagaaaagtttattagaagatgaaattttcaatgaatctataattactggtgagggaatataattattttaagattcttcttttcttgcatattgtgacagattttcatgctttcattataaaatcaacatggtggtgaattaccaagttcattattaacatgttgattgtcctttatgttgattttaacattttcaaatggccaaaaggttttattatttgttaagttgagagtagaatttgtaaaattaggcatgtgttgtcttttcatcttgtataaaggaaattttgatgccaaagtctattaacttgtttgtgattagtttgctttttcataagagaatctacaaacgcgaaagggcaatgaaatactcagttatttggagaaaacctcaaaagggaccttgacttctttacaataatatgcatcacgtggatttccacttagatcctgtcaagtgtagatcggacgacagtagtttcatatcgatgatttgagccattggatgtgatctactatctctatattgcttacacaccaaaaatcttgtgatttggagagctctgatctatgcatcaaatagtcaaaaaattagacattttaaatgacatgaaacaatgcatgtttttttgaatacttgatgcataggctgcgggccttcaaattatatgattttttatgtgcaaacaatgtaagagcaatagatcacaccacacacacacacacacacacatgtacgagttttcacttctgtgtacacacatgcatacatatgtacatacatacacacctacatatattatggtgtttgaagtttatatggaaaacagttttatgactttgatgagtttgaagttcgacatttcatgaccctataagttttatgtgatttgtttttgttcaggtgtatcagtggagttgaacaccttacacaatcgaagatatgattctgaaattgatgaatctcattcccgtgctgacccatcaaaagaggctgagctttctagaagcttagagtttgttagagaaactagtgggaaagaaatggccgagtccattccagttatgccaaataaagttgatgttgaaacacagggaccatcaggcacatctgtagcagttgaggcacagcttgacaaaggctccagtgaatgtgatgctcaagagcatttaggatccctaactgatctgcctcagccagatttatcaaacaatatccaaacatgtgatattacaatgacggaaaacaatatgcaggacgaaaatgctgaagttcacttgtctacacctgcaacagattgtggagctgaagatattgcagttcacaagaatgaagacattgctccatcctctgagaatgaagatttgtgcatgcattcggagtggcaagcactgcatgggtcagtacaacctgccagtgagctctcagagatgaacaatgaagcattacagacgactgaaatcacttctgttataggcttagatcttgctgaggatgaaaccagaggtaggatggttgatgaaactgcactctttgttgtaaatgatgataatttgttccacactaacatgcctgtattgctacagatgcttccgtcgtggcaggaaatgggggcatagcagctgcaggaaacataaactgcccacatgatactcatgctgatgttggtaagattggacacacagagacattagtctctatacaagatagcagtttacttgaagttgaggtatgtttacaaacagactcgactactattagacatttgaactctactatgctagatgtggccatggaaggtagtgaaatagctgaccctgttgctgtaacttctcatcagactgtgcagggaaaagacaatggtttagatgctagagtagaagatggatctgtgatgcagaaaaacttgcataatgaagtgaactcatttcaaccaaatactgaaatcgaaaatgttccatctgcagttggagaaaattctggtttgcaggaacttaatgcagagggtggtatggatgtagaaagtgcttctgtggatcttgctgctgcaaaagaatgtagtgtaagttgttgacttatttaatgcaaacatgtaagaagaggcctgttcaaagatcatgtgttaaattgcagatgttagtaaagatttatacttctacagaggtatataggtatatgtgcacatccatctatgcgatccacacatgcccataaattcatatctttgaatattattcttactgtaggtctgtgtgacaactgccacattttgaagttggtcatattgtttattttcatttggcataattcacatcatctagatctctctttcattctccactaataatttttttttaccattgtgcaggattttggcagtgcagttggtggcaatgatacaggtaatcttctagtcatgatctagatctgcatcatttctccatttttttctatgaaaggattgttatctgagagatgccatagacttcaaaagaccacacctagagctataatacacttgcaccagtgtgccaatggtttgtctaagccttatttcagccgtagtcaattaaacataactaaccgtgttctttcccattaggctaacgtgtctttatggaaccttttaatattcttctcttttaagaattacaatccttgttgaagcaagttctatgaagttcatgctcgcatcttgttatctatatactttcgagttgtctgacccttctatactttggaaaaatctaaaccccttatttgtccttaaagttttgttgtacatgcacatgctgcccattttccttcatttcttcttcaattggttaaattgttattcttctccaatgtattttttacctttgtgatgccagatcttctgcacatccatctaatttttctgagggatgaatcatttcttaagttgttgtaggatcataacctattatttctgagactaaagtaataaatatgtttattctttattttctagaggaaaggcataaccaactgtttattaatttagccttctaaattgaaggcttgagaacttgtgatgtttatctttgtctttatacatgattttgtgttcttttccctgtgttatgagtcatctctatcgatcagaatttggtccatcatagtttgagaatttgatctagtttgatgttacgttgttaacccttcatgaactggtgccgatgtcttgaccacgataactgtcgatgagggagctagaacagggaacaaattagcatgaggggaaacctgcctcagtttttgcatgaaaattagggaacagccatccggctttttccaagacttgagatcatatggagtatggaatggttcaatatttggggaacatttggcgctgcgtcaacactattattcccttttgaaattctttggatgccttacttgaggacctatcatcagcatgatcgtttcttatatggaataagttccgatcagacaccacaaaaaaagggaaatagtagatatctgatctcagatcggcacttgcatggtaagacccttatgcgagaatgagaaaagagagtggaagacagagtgtccattcaatggattggtgttataggtgctttattattatgttatgagtctaggttatcaactaatggcaatagattaaacgtgcatccctttaaggaaattttggtccaccataattcctctgcaatagtctgtgtcacaaaatctcctcaagggaagggtctgtgggatgggtgaaaaagaaaacaaaagaacttgaggaataagaagagagaataagaaactatggaaagaaatggagcaagaggtagagtgtatgaacaggcttaccggtctttatgccccttgctacaatagaagcctgatttgtgggtgttgcttaagtgaggaaaatgataagtgtgcttaaaagaagccaaaatcgtgcacctcagacctgataattgaatggtaatccaactgattgacgactatatgttccttaagttggaaaaataataagtgtaccaccaaaagatgttagctggctgcttatttaacctcatgcatatttgcacccaacatgtgttgagtcttaaaattgtcttattgagaatcaaatgacaacagaaacagcaatttgacttctaaattaacatttctgttcggtaagttctctatgtcactgaccattcatcttgctatcctgtttatgaagtgctcatctgtttacgaagtactcaatcttttatccgagccattgaatgtggtctactatctctaaacttcccacacaccaaaaatcatttgacttgaagacctttagcctatacatcaagtagtaaattttttcacattatttaaaccagaccaatttttgactatttgatgcatcaaggtctccaaatcacgtagttttcagtggagaagcaatttagagatattacatcacaactaacgcttggatcttggatgtatggcccctatcatctaattgaaaaaagatgcaattctataaaagttacaatagctataatttgagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatatatatatatatatattcttttttttctttttttgtggaaaaaatgaactagtttaaccatttcctttataacatcccaccacgcaaaactcttagtcagctattttctttctgcttctgtccatgtcaaaggtctttttgacaaaaagaaccagctatttatggtcatcaaagcatgctcgtgatactattttgtaggctcaaggaacaaagtgttataggagattagttgcatcatagttacaatgtgaaagttaattgaaaaggcaatgcgatattcactgtgacctaaaagtgagttggaggattcacatggtagatataggcatgtttcagcctttggcaattgattgatttagcacttgattttcatgtaaatgctagttctgtctgtctttgctttggcatctatgcaaatatatgggaagtttgttttcattactgactttcataaccttcttccccattttgtgtatcagagtttcttaatgtagatgatgaagccgactatgatgatgcagcagatcatgacatgccgaatcctgaagaggcccagtcagttgaaaacagcggctggtcctcccggacaaggtaacctcctcaacttgttgtttcatttatgtctattatttatttctttttgccagtgactttgtgaatgtacactgaattgtttgtatcaatcttataggggcgttgcaaggtatttgaaaattttgtttgatgaagaatctggacgtggcagaaaacttgttgccatggatcgccttttagctggtaaaactcgcaaagaagcatcaagaatgttctttgagactttggtatgccaatcttctcagattttctttctggctgtttaaactcaatctgtcttctttcagttaaatgttcttgcaagcaacaaaaatgtttttgagttaaatatctcataatcatatgttgtgttatactgacacaacaaagttatatcaaatacatatgtcatacatgcatgcacacatacatatgtatggatacaagatataggttagaagacaaaatccacatgttttacatgggtataggttgatgcacatgacacattttgatctccttatcattatagttatctaatttgctttggtgaggaaggccgacatgctgcattgtatattaactgttaccaatgtgtaacatgggatggctttcatcttcctaagggttgcaactcctctttctaaccatataatttttagttggactaggtccaccagtgagctggtggatcagtccaaccatgaagcaacatgcacgatcagtccaaccatgaagcaacatgcacggaagcatgtgtattgcgctgttttctgttttgtctgtccatgtgtgtgttgctccacagttggactggtcccccaattgagcagttgacctggtccaaccaataaccactcctttctaacccaccccttaatcttccactgccacctttctcgttgattatgcctcagcttctgccactactttttgggcttccttaacctagcccccacattccttgttgcttagtcatctccacttccacaaatctctcccttttccctggatatattttctagaagaccatggatcaaatttgctaccatgtgttgtcataaatcaggtttcagtatgacccctttttgtcacaaactaatagcttccgtaaagagcatcaaccaacttaacacttccaagcataattgtgttctacaaacataaagaatatacttttgagtttcatcaattatttccttgtgtttctactatggcattcttaacaatggaatttcttgatgagatgaaacactcagacacacatacacatgtctgtctggagaataaaaatctcaagtcatgaagtgtaaaattaattatagaagtttatgattgtggatttcaatgctgatcattatctgcaataatttaagtacctagagatctataattatatattttggaggtgttttatgcattgagctgccaacaaatggagaacactaaaagaaccagcatgtgctggaatatgtttttcatatagaatctgcatgtcgattattgatctgtacattctagaatatgtatttcgaggcctttttcatagatttggtgtttttaagccataattcaaatcaaagcatcatatcatgctattgaaattgaacattttgtgattattgatgcgtaagcaggatatataggaatgttcgatttccagtttctaggcattttagatgctttatagcaccttcgttggtttcaatcctgctatcaggaatctctctctctctcactctatgcgtgtgcgcacgagctttcatgatctattgttcctgtcattatttttttgaatatcagcaaaattcatattttcatctgcccctctccttttttttttttgcattgatttgtactcttttgcaggttctgaaaacaagggattacattcatgttgaacaggacaaccctttagaatgtatcaacatcaagcctacaataaagcttctgaagtcagagttctaatccaacaggcacacaataatataaataaccttgtatttctaatttatcgtgatgcttgctccacccttttcgttgttcactcacctcgttttgatttctacaaagtttttatttccttttattgtactgatctcgtagcttggggtggagtggagttggtgcatgtgtttgtataccaattatatactctgtatatatatttgtaaattaaatcatttagtgttggtattctgtgaagttaactggtcttcatgttccttcaatcagaaagttcttttggacctttggtaactgtttaactggtggcttagggatgcaagttgtatctagttgatgatgatttcaatacccacaacaacccccctgcagcaattgatgcagcctgggtgtggtttggatgttaataaattaagttcttgtctattcttaagggtggtgtggatatgttaagttaagctcttgtccattcttatgattttccagaactaaacggttgagctaacccagtacaaggattttgaaaaatgataacctagcatgttttttcaaaattgatcaaagtatcatgtaacactaaagggatggtaggaattttttaggtctatattagttatttaatctattgattgatggttctaatcaagattattattttcagcttgaccaagatgtgagattgagccaattttagacaattggtgctgcattcttgatgtgcatgtgtatatgtatgtatgtatcatctcttgcttcttatgtttgataggctgctataactcaaagtgagacttttattagtttgttatctttgagtttttaagagtaatgagtaaaatgatttctactcgtcttatttagtattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagaagttttcagatattaatgcatcatgtctgatcatgaaggaagagtttgtgcttatttagcctttctttggcagcactgctccgatgatgatagcacaacaagacctcttttattggttaccgcttctgtagacaagatggttttaaagaagccattgcgtgtagacacggatctgaaaatagaaggtgctgttacatgggttggtcgttcatccattgagatacagattgaagttactcagtctcaacaaggtattctgggcaatatatgtgttgtttataaatgaaatttgaatttatctgaccgttgaggttttgtccattatgtggcagataactcgataccatcagaatccatagctctgactgcaaatttcacatttgttgcacgtgattcaaagactggtaaatctgctcctgtaaaccgcctgacaccggagactgaatcagaaaagttgctttacaaagaagcagaagcaagggataaatggaggaaaaggaagagagaagaacagagaagagaaactgagaatggtgggcacagatttcatggcgagaaactaaagattttgttggcagaggggcgtgtcttctgtgatttgcctgctttagcagatagagacagcattctgatgagggataccagcctcgagaattctctgatttgtcaacctcagcagagaaacctccatggacgaatctttgggggctttttgatgaacctagcatttgagctagccttttcgactgcatacgcctttgttggacagatgccttgctttctcgaagttgatcatgttgatttcctaaaacctgtgagtaaccaactcctactgcattatcagtgaagtaatatctgctattacttctaatttggtttcttttttccctcttaaatagacaagaaagcttattggttaactgtaatctacttgagggctgctggtttttattagaaccgaagtttgttagtttgttttcctggtatcatcctagctgatggggagtaggttatattgtcaccatatgtctggtatttctagagaatttgagtacaaatgtcaggagatgtaaccgttcattatacattcttaggtggatgtgggagacttcttacgtttgaagtcatgcgttctgtatacacaactggagaatccacaggagcctctgatcaatattgaagttgtcgctcatgtaacaaggcctgagctccgaaccagtgaggtaagcatttgaaggaaacctggaggtagaagtttactataaattattcaattcaccatggatggtcattgaattaacccattaaatttcatggataattgttctcttttggcccatgagcaggtatcaaacacattctacttcaccttcactgtcaatcccaatgccttgaagaatggactaagaattcgcaatgttgttccagctacagaagaagaagcacgccgggtacttgagcgcattgatgctgagacaatgtttagttaattcataatctagctatcttctttagtgaaaggaaaaatggaagttccagaagtcgtgatgcttaattttgaataatgtagcagtaaatatggaacaccatgtgctttgagaaatcaaagaaggattcatcttatcatttcaactagatgctatactattctgatgagaaagatttaatgaagccagtcattttaaatgttactactagcctcttttatttgtgcccttgcccctggcttctgttcttctcagggaaagcattggttagtgactggattccatgcattacctgtgcctaatctgtttgtcaactaactacaaagttggaccaggatttatgacctgactctgagttggttgcatgcagtaaatcattttccatgcaatcaagcatatttatgctccagtaccctggttggcttctaaacactcaaacaagtataatcacatgttgatagttttatgaaatgattaatctcagaaatatagttttaatgaatggcagaagaaattaatatttttccaatattaagtaaaccataaaaataataataaagcttacaagcaaaatccttttttttcgttgagcctctataggaaatattcctggcaagggcctgatccctgggattgaacctccgacttcttgtattgcttgtcatgttaagattactttgtattgctcaagtacctcctgaattcctgcagcctttagggtccattgaaaaaaataataagaaaaaggaagatgaggaaaaaggttgagaaatcaaagaaggattcatcttatcatttcaactagatgctatactaattctgatgagaaagatttaatgaagcctgccattttaaatgttactactaacctcttttatttgtgcccttgaccctggcttctgttcttctcagggaaagcgttggttggtgactggattccatgcattacctgtgcctaatctgtgtgtgaactaactacaaagttgcaccaggatttatggcctgactgtgagttggttgcatgcagtaaatcattttccatgcaatcaagcatatttatgctccagtagcctggttggcttctaaacactcgaacaagtataatcacattttgatagttttgtgtaatgattaatctcaataatatagttttaataaatgatcgaagaaattgatatttttccaatattaagtaaaccataaaaataataataaagcttacaaaagcaaaatcctttctttttcgttgtgccttgataggaaatattcctggaaagggcctgatccctgcctgggattgaacctccgacctcttgccaatggtaccatccaagctattattcaatggtaaaaaatttactcgaaaataggataagaaatttcaaatgccacttttgtgacctctataaatatcataatctaatacattccaactatactgttacaactcttattcatgacgtgcatcaagtagctaataactttatgcatagccattatgatgttgcacccaagtagttcactggaatttcattctttctaaaaaattaaaaataatgataataaaaaaaaaaagaacattttcaactaatcttgtgcatgttaagatcactttgtattgctcaagtacctcctgtgttcctgcagcctttagggtccattgaaaaaaataatgagaaaaagggagatgaagaaaaaggttgaagttaaaaacagagagaaagcaatcggttctattcatgtatcaaattcatgaaaaatgaattcgtctcgttctaaattatcttctccattataatttctagatatttagaagcaccaaaactatctttcctatttttttgattgagaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggcagaatgatttatccgctgccttcggtgtgaagttaccctatgatcaagtcatcgaaaggatcccatccatcatttctaaaattaaaactgttattaaggcaagtctatcctatatatcaaattcattgatagttcataacctcaaatttgcaactatttgcattagaaattttatggtttaagcatagcaatagcatgtcatagttataatcagatggaaaatctaaatctacttgttagcttctttctgactatgctcaaactttcactatagagccccttcattaactgatctaattagtcaaggattgctcaaataattcattttctgcaagaactctttatgatagtctctttcatccatagttgttttataatgacttgggagattgtagttgtttcaagtcatctttagactgctttatctattataattaatggcgataaggccttgcctctctcgaatgcagactttgtatggtagtggtggacctccatataactttaatcagaatgtaacaattttttcttaattttcttttttaaaataaagaccagtattcaaggatcttcttttctaaaaacattaaaacaaacaggcccatcaaacccgctggcataacgggccaacgagccgtgcctaatacggcccaccatccttgggccttggatcgtgccaggccaggttttgtttaaacgggccgtacccatttagtcgcgcccggcacggcccattgcgcgcgtttgctcatactagtcttgtttgtgtttcttaacatattttcggttttctagagagcaaaggcgatgatgagttgtggtaacctcgaagaaacaatactcatgcaaaccatgaaatgttatatagttcgaataagtctcgagactccaaagtttattcaaaagagtgctcaatattctccccttgatatataaatatctagcactctaacaagttaatttttatatcattgcatgtccggtcatgcaaaggtcaagcctaaaaagcaagccatacaggagcgtgcggccattagctaaattttcagttcatcttagatcaccatatactcacttctaaagctcattacttgtagcttcattgattttttatgtttccttttgaatcttttctatgaggcatgctttctttgtgccttgcaatttgttgcagcctcataaaccatccaattctacatcagccatagccaacccagacccagaaaactcatgaagtttagtttcaaagatctttaaatgatataattatagaaagaacataatgtccacctcataggttcatatcacctatactgttaagttgacactcttaacaatgtgctgcacaactgaaacttgttctggataccgcacattgatcttttgagaagaaaagctttcaatagatatacataatctgagtcaaagaagacagtttcccaacatttctctcatctagatttcctttctgtatatacatgggcataaaaattccaagaacataatgtctgcctcataggttcatatcacctataatgtaagttgccactcataacaatgagctgcacaactgaaacttgttccaaattctgcacattgatcttttgagaaaagctttcaacagatatacgtgatctgagtcaaagaagccagtttcccaacatttttctctaatctagatttccttgtgtatatatataggcataaaaattccaagaatcttttacatccatattctacaggtacaaaaaatatatatataaataagtggcattttgattccatgtggcactgcacttctcagctgatagccagcaaaaccttctactcgaaagaggcatcagccaggagcactaagcgttaagccttatgatgacaatgaactttcctcatcagagctttcaggcctcaatgcctggaaccttgggaatgcatgtggtagtgttggatttacaggtactgggaattggcgtgctgagctgacaatggtgcgatcatttatccttccaacctctttgcagacctgatcaaggatggctagaaaatccctgaccaccatgaaaattctgaaagggtgagcttcttctttggctgagttgccatggaaatactcggttatttccttgaccaaagacagtgcaacactctcatgtgcctggattttaatgatctcgtcctctgccttctttaagaacccactcatagcatcatgaaattgctggctattttcctttgaattcaaggtttcattcaatcttaaaacctcagttattttcccaatcccaccagcaagtttagagacatagctgctgagcacctcagaatccattgtggctgctttcttcacattgctgagctcacacccaaggccagcgacagcttggaggccaagctttctgcactcaaggtcatctcgtagagtatttgcctgggttttggcagctgatggggtcacggcagaaaggcgggagccttcagatctgatgatttcctggacaacaaaatgcagaagagtagtcttgccatcggtgcctttgacatcaactagcttgagtagtgtgtcaagcttaaaggcatgtgcatcaccacggttggtaccaacattcatgcggttcccggtctttagaacggcttctagaagcttcagaaacaatctgctgtttctcagatcatcacaggctgcctgtgcattgcaatacaagcagtttgttagtccaaagaatggctgcaacccaaagagaacacaaaaatgaccattgcctattacatagggcctgtctgatctgtccatttacctctgacactagcttctttgtacaagtactgattgaattttaatgatgacaaatgcaaaattcaacagcactgaacttaagtttccatgcagtttcatacacccgggaaaccaattgataatgaagcagttctttcctcaacatggtgtagaaatggaatgtgtgggtgagacgaaaactaggaggacatggaaagttggaaacattaactataaagtgaaaaacaagttctaattataagtgttacataataacacaaacataagtttgtttgcaattcaaataggatattgtgaaatttattctcataatcaagtgtaaagttgttgatattcttttttacgtggtgtgcatgagcacaagatggagaactctgaattactggtaggtacatttagtcaccagatatatgctctcttctagtttgttttagtgatgatgggatgcatccagtttgtggttccctaaattttcacattttccactcaatttcaacatgattagataaggatatcagtgtcaatgattatcatgtatgaattatgattgagaaagatctttgtttatgcagatatattggcatagtttctaaaaaaaagatatcaaatctcctgcatatttagaagaccacaattctgttcataagtttttgaactatccatatttgacaactcaattctataacaaaccaatatatgaaaaagtattgatccattcataagataatgatttcctgcagcgcataccattagaaaggccaaaccttaagtgccctgcttcagctgggtaagtacaagatttcatattaagatgccaaatggaatgcctatttggcacacgaattcatattgagcagagtattattgtacatactagtagataagataaattagaatgtttggcagaggaagataagttattaaactttggtttaactgggggcaaagggaaggatcaagagatgaggcagtagcagcaaactctacatgagaaagatactaacttgagatgaaaaacaattgatgaggctataatcattgtatcaattgctaatcccttcaaggtcagagtgtcagactatactcaaatgtacttgaacattttgtcgattgttcaaattatgaaagaaagactaaaagtttatattgttttaaacaagttatgcttcatgtatgggaaaataatcagtgcagaggctaacatgagcattattttgttaatctgaactctcaagactatctcttctgtctttagtaaataagccatgaacgctgcatgatatatgacattacttcaatgaaaattttgctggatggcaaaagaatcaaaagcagcaggtcacatggaagaattgcaaagtacatacataaataaaaatttgccatagtatcatagcttctggatgttttagctgctctgaacacagtattgcatgcaaccctgatcatgggtcctgactcacaggtcacaacctgattactaaagcagaaaaagatcctaattttgcttactactaaaccaaacaaattcttttaaaccactactttatctactattttactagtgattgacatgcgatagttcacttttttcctatccagaatagaattgacaaaaaacaataaaaacattagatttacctcaagagtttcaaacgatttcttaagataattgacctctgaatcaaaattagcaatgtaaagcatcgcatccactctcttaaaagcaaacggtatatcaagcactgccttgagaaacttttctgcaggaccaagcttgatcggggaatcatctttgtactctttcaatttaagctcttcttctttgcttggagccatctttagcaaagtctccaatagctcagttcctaagctatctatattacctgcaattactcggtaaaacatatataagtaaataatcaaccacaaaaataccagtaaaaataacttcatttgagttaaaattgatatacagaagacttcaacaactgaatggctaaaacaaatggttcagaaaatattggcagtaagatgtccctgttactgcatcaaataaggtggggagttgtagtccttctagacaggtaaaggtcaacgaagagaacaagaatagcatcatcaaattcataaacatagatacttaaaaggcaaacatgatacttgatattgcatttcattatgcatgaccaaaaaaagaaagattaaacagctacaattgatacatgacagaaaagtttgagcttgatgcagtcatcactcttcccagcctgactacaaatttcaattatcttaattaaattagttttgttcatttgtcaactaacatgtaggttaaacaatatgatgccaagacgatggagcaaaggatcaaattgaaagatccagaaggttttaaataagttggatacattattgaaacaatttgtgatacgctgagttgacttcctggcaatcattatcagcatatagattgctaccgaacagcttttttattttactatcattttgacttacatttccaaacagctgttgatctcttcgtgaatggtgagcagtgatgcctactggaactaggtgtcattcatgggatttacttcaataactcatagtgttccagtaatttgtaattcctattggcaattatatgattgaagagaaaggtgtgttttgcaatgtaggtggtgctgaattaagggaaaacaatacatattcgggttttctgcttggcatctgtcaagctatgagcatgctgccaaatacagaaaaagaagcctatttaaaggggtgctttaatcacatgcctcaaatcagtgacacatccaaacatttatgctcttgacccaagaatgtgacattataactgatagtttccacaacaaaactctagttaatatcttgcggccattgggattaggaagctcaccgaaacaaaagaagcaaactgatgttctttcacaatgatataatcatcgaggaaacatgatcgcgtaggccaacaaagaaagaacacctaacccttggctaaaatatagaacaataacctttttggaggcaagtggcaaaggggacagatggttacatgtaaactccaaagcaccatacctcaccatcttttgatcagctcagtcttctctaaaagcatcatgttgttcttttactttttgcttgcattagcagcatgcaaatttaaaatcaagaaattagctgatctattttccaacatacaccgagattgagggagagtttatacgtgaataggtggatgaaaagtaaaatctataattttgaataatacttttttcagtgccttcatattccaaatactggaagaaagtctggtacaaacagttcataacggtgatcaaatctgattaggaaaaaatgagcactggcgtagaacatgtcggcgcaattaaatgcgaatgagattcagagcaaatggctaaagaggtttagtgtctcaccttccaatagggcttcacagacttcctcctttgtcacattcagtgccctcaggaggatagcaatattctgagacttcttcggatcaagcaccctgttatcttcatttggaattggaagcacttgtcgcttgttcgtctcctttggggctgtgtttgttgcattgcaaacaaacaaagtctcaatcatctcctcatttactctgtcaatagataaggcgagagtttcaaaaaaggaagcatttttatcacaatattggtaataaagttcaaaaagagaaagagatctaaagttaaaaacacactggaatgagctcgatttcagctgatcccacaccatttctcgatcagagctcgcccggaccttatcccagtgcaaaggcttcaactttgggcgaggggtctcctcgctcttctccactgcatccgaattcaccggagattctgctgggaaagccgctgtggaagaattcttcattccagtaggtctgggaggagtgagaactggaggctggctagcctgtggctttcggatccgactctcccagtaaccaaccggcggcggcggtggcggaggaggtggtggtggcggtcgcgatgcagctggcctcgacggtgctggcagcggaggagcttgcctcagtggcggcggcgggagcggcggggcttgcctctgcggggggctaacaacaaatgggttcctcgagaagtccccaattctctgcggcgatcgcaagttcggacaggagaagtccgagatccttgagtttctttcttgatccttctccaccggtgaagaaggtggggagggagaagggggtttcctctttggaggcgaaggagtcagcggcccgagcggcaggcggggcggaggaggcggcagtggcgggacaccgaggtcgaccaactcagcattctcggatctaggtttcagagatttgacgctggaccgtgccgggctcgatccgatcggcggtgacgaagccgccggcgatgatggactcggagaagacaccgaattggacgacggatacgaaggcgtgctcagcgtggagctccgggacccacatttctccatcggggcagcgacggccgggaaagtccgctgtgaggtggacatccggccgccgacgagacccccggagctctccttgtcgccggaagaccctttcggggagtaaaattcctcctccgacgagcacccgccgtcggcattcccgtattcgcggcgagcatggcgagataaggggggaagaggatggagctccggcgagcccagcttctggtagggagaggtgttgggccgggggacggacgcggctggggagggatcggcggcagctgtggcggcggcggcggctgtgcaggagttcacaagggtgccgaggtagaggaagtcagaggtggggggcttaggggcggcggaggcggcggagccgggggggaagaggcggatgctgtcggaacgggcgttcttgtcgtcatgggacgggagacgacggcggcggcggcggacgaagaaagcgagggagaaggcgaggaatccgagtgcgaggagggggagggcgacggcgggtacgagcttggcagcggaggggcggcggggaggagcagaatgggaattggggaagatgagggaggagatgttggcggggagggaggagccggtggcgggggaggagggaacggaggggggaggcgtggaggggtataatgggaagaagggcttcgggttggaggaggaggggtatttcgggaaggatggggatggtggctgggccggcggtggggtggccacgggaaagaagggcaggtggagggcccgccgtggaatgggcgtggtggatgagaccgccggagtggagaataacagcaggaagagaagcaagaagaaggaagggactggcatattgtgcaagagacgaatgtgagagagtgagagagagagagagagagaggtggctctctgttttcttaatggtctaataggagaggaagagcagaacaacggtatgatcttcttttcttttcttctccattttccctttttttttttttgttgcctcctctaccttggcttcagtaggaggaaggaaggagacgagaagatcatagtagcagagcaagactaaaacaattaattattttctcacaaatatttatttatttgggagggttgtgatgtctaggagaggtgtaggtgtctgtgaaataagatagtgtgagacgaatgaaaggggggagagagagagagagggagcattgcttgtaattatttgggcataagcagtggggacagatgggaacggagtagaggagggtaggcttggtggtgggagcgaggtgtgaagaaggggaggtgagaaggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagcaaccggcggaagctttgtccacccaaggaggtaaaaaaatggacgacactcgcgttgggaaatgcccactgaaggccgagaaaacattgtcggccggagagaacaaaaatgtggcggagatttttttttttaaatgattggatctgatgatgtcaggatcatttgtgcctgtgaatattataaaatattttattatttaattttaaaatatatattttaaatataaaaaaatataaatattatccatttgaatttatttttgtatctaaattaattcgaatatagataaaaatttaaaaatccaactaatatatatattcgtattcatatctatcaaaaaaatatggatatgaatatggataaacaactatccgatctgtatccgaatatccaaattttcatgaaatcctatataattttatataatacttattaattttttaaaaaaatatacaatcatataaatatattattaatttatcatatatttagtaatatttttgattgtatagtcataaaatttaattatctaaattatatctataattatatccatactttcaatattcaaattatatctatatctatttaaaataaatataaatataaattttttcgttcaaataatatatatctatatttatattaaccaaataaaataaatataaatatagatatattgatatttatttcgtatttgatctatttttgatctcaatgtacttattttaaattggtacgagcggctgtttgtatagaagaaaaaaattggcgttcatgtggctataaaacgaatgtttaaaaaaaaaaaaaaacctcatcaacactattccatcaggaaagaaaaacactattccttttatattatttttctctaaaagagctggggaaaaaatactttttaattattttttggtagcctttaccaagtggaccccgcgtctggatctctgggaaacgacaagagaaacgggaaagcggaaggaatttgaaccttaaagtgcgtgaaacgggaatcgcggcgtggagtggttgcagcatgtgcgcgccccaagtaggcccataagttaggattctcctgggaggttccaggggagcgacgtcagcgggtctgcgaggcgccggtcacgaagtgtgcacgtgacaagagctgcaaatgggccagcatttgagtaagttggggacattcgttttgttttctttctgatgaaaacaagtgcaaatacagcaccgtctaatttttaatttattatatggttttttacgaaaaaaactatcaaacatgatgaagtactgcatgaaaaggattgacgtgcgcgacaaaacatctgtacactgaattctttggcagtggttggatagatatcaagtccaccgaccagtgagattttttttttttttttggttaggagaccagtgagattaatttccatccattatcatataattactggagaattctgctgctcgactttttttatgagatgatacatgtttatagaaaaattaataatattattgattgaatagtaatatatatatgagaaatcatatgagaattatattgtagactgctgtaattgatatttcttttaaatttttatatattttattttttaatttttatggatgcattttcattagaacggtatgaaaagtttggcttatcaaaaaaaattatcaagtatcattctattcttctctctcttgcttgatctggtataatacccgatgaatgaattaatctccatattgcattttgtgtcaaaacttgaccatcaactatgatcaaaagtcgagcattgcatattggtactattttcatattacaatgatatttccaagtaacgagaccacatattttaacacatttgaagaaaaatttacatttagaagttccatgttaagataatcgatggcaattcatggcgtatggccttaattaaaatgagtgttctcgccctaacaacctcaatcaaaaaagaagttgataatagttaaggtgagtatatttttattttagcaaataacaggatctaaaagagatgtctatactcatgagtaagatgcatttgatagaaaagctcactagatataaaagactttaaactttcacagaaatagttctttttggaacaggcttggtcaggcaccatagctttaataatttctactcgcttcttggtttcaacaattttgtcttgatcccttgttaaaaatcccacacaatgtgtgggtcttctccgtatctgacaacgcagttggtgggaacaattgttatctttgaaatgcccatgtgaagttcccctgtatctctttgcaacgcaagtcctctgaaccttcttgacccttaaactgcacttctcgtgatgactttagaatagctctcagcccaaaggtttttgtaccccggaaaaatggtagaactccatccagtttctttttgtatgtcggtctaatcttctttcattgtggtagtacccatcaccaagtaacttccttgattttgctaggtggtctaagataattaaaggtcccttcaggtatatattggttgggtgatttacacacgatgagccattttttaagaggaagatttacataggctaacttcgtattcatatataatttaataatcactgaggtgataaatgcagtatatatgaagatcaattgcggtgatagcacttacatacaacatctgctgctcctcatactgatattctttttcccgttgaatgcatgaaactattggttttgaaagtttttaaaattctattaatagttgcatgagatcaaaatcagtttgatcggatttggattcagatccgatcaaatcaaaattttatataatagaaattttatatcaatgatccaaattattgaatacaatctaccatctcaaaattacttacacataaaatatcatatgatctagagtcttctgatctatgtatcaaatagtaaaaaattgagtagtctaaataaaattgaattatatatatttttagattatgataagttagagattttcagatcatatgatttttgatatgtaagtagttttgagacagtaggttacattcaatgacttaaatcattaatgatgaaggttctctgttgtctaattttgatctgactgaatttgaatataaatttaattaatttaattaatttttattttttattaatttatagaaagttaaaaattttctggccaatttatttctgtttgttgattttttaaaataaaaaataatatgatcaggtaggtcttaaatctaaacatcacgttgctgttagattctaatttaatgatccaatcttttctctggagcttcttattttattgcatggagtcgacctccaatccctatgcatgggaatattgatcactcgaccgcaccaagagcacatcactgacagcaccaaccgccattaacaatgcaagaaaggtatcatttttatattattattactggtcgtaatctatttgtttgcatgtttgtttaatcttttatggaccatcaattcgagcacgcaaaagcacgtagcttccgggtctgacgcagtgctcctggcttggggaagtggttccagtgcgaatatgtttgagtttctgggggacattaataattattatgattatgtacgagatcacgtgagtaggatggagagacgctaacaagttttgttcttcgtgccataagttattaaaagcattgttgttcatgatgcaacatttgacgaatgtcatccacgctgttgttctccggtcaaagtccaggagcactggtgacgcccaaggctccaaggctccttccttttggacctccatcgcaagtaggggcagaaataagtcagatcagatcagatttaagcttaaacagatcagatctatattataaaatattaatttgaatttaatttattaaattaatttaaattaaaaatgagactcgatctgatctattttgtaaaataaaaaaatctgacctaatctgaaagtctatttaaaaagactcttttatcttcttgattctcgaaaagatcaagataattgaatattgatgaataaaatcaataattaattaattatatatattaataaaataatattttttattaaattatatatatatataatatacagaccagcctgcagactttcagatcaggctttagaattttaggcctgacctatttatttaaacagatctttttaagagtctatacttaacttatttagataaatagatcagatcaggccgtaggctcctgacaggccatctggtctatttccacccctaatcacaagagagaaagtctctgtacaccataataaagttgacgtaaaacgtatcaaagattatagttattatttttttaatatatatttattatttataattttattttttgttttaaaattttaaataataaaaaaatttaaaaaaataatgatgtattataataatattatgatatcctgtaatcaaattataattatatatatataattttatatttttttaaaaattatataaaaaatatatttttattattaataatttataaaatttttaaataataaaatatttttttataatattttatatgcagaaagtcataatttaactataggatgtctgacagcaaaatattataatttttttaaaaaatatttttatcattcaaaatttcaatcgaaaaataaatttataattattaaatatatattaaaaaataaaaaatatgttattcaatcagataggcaacatattttttttatagcaaatatgatgtacaaaaaattatactttatcataatagtatccctcgcctatatgttcggacgctaagtggcgaagatttgagaaaattaaaaaaaaataatggaggatggcaaataaaaacttcaaaaatcgctactactagaagtatttagtgacagccaacgataaccatcatgccagctattaaaaatcacatcactataataattatatagatatctaataaaattaaaagaataaattaatatcattatcatctttatcattagctatttaagtaatataaataaaattaatatatataaaaataaaatattatcctgtacgagaggaagaagaaagagagggagggatagcatccagtcgttggaagtgaagtaggggacagggaatggatgctagcaaaagatctctttccttctggaaaaattaatccactttcacacgtttcatgtagtgctatccagtgatacattaaaattgatatccatatctcccaagttactactcctctgtctaaaatcatttgcatatcatttccttgttcaatgcatatcatttgcattcgctcctccaacatgatgctatgattgctaaatataaggttttttttttaatccccagccaaactatgctaatcttcatgcatggaaacactaaatagagtgcaatatatgcacagaacttatttattatgattattggtaacgatatgtcaataataataaccgctggtggatgacaaaaaggattcctttctatggattgtatataaaaagtgaccatgttaaaattgggtttattttcagaactcgcaaaaatttccatgaacttaattttctgaagcgcttaccatgatttctaatgatacatgcaagcacacatggtcacatacatgaatgcatgcgcatagtctaagcaatttatgtataaagttaacccttcacggttgcttgcgttttttctatgggcaataaatgcaggtagatggggatgcaggggtggggacaaaatattatgatgttgcaatgctgtcatatcaataaaaatatagaatactttgattcacaccgattcaaagcaataaataataataataataataatggagtaattagccgatgggattccttaaaaaaataataatattttttttgaaaaaaaaaaggcttcaagacaaccacaaatacatgcatttgtctgcttgtaacccttgtcaattctgaatttttaatgataacagctcaatcatgggctccaagaacagagagttgtggtcctccaaacacacatgggcttctaatataaaaaggaaatatggtagaatcttatagctaaggagctttgctgacaatctaagaagaaggttgagtagtgatggaaggcaaagggccctgcaaataggcaagagtaattttattctaaacaggtaaataattacagatacacaaggcctaaagaagaacattgatggttgctgtattgataaggaatgattcaataccagatccatctgtcatttgagaccacaatgatgtctgttgtgataccatggcctaccatcatgacctcttggaaatgtgatggaaactaaacctgctgacctaccactagctgcagtagtatatttatggttatcccagaattttcatgtttggggaaaaaattctagtactgaaattatctaaactaactttcctaatgttgcttgtgttgacaaaagaaaaaaatgatcttggttctggatttgattaattaaatgtatgagtaaattatcttacttaaaactagtctctcttggaaaagaaaaaaatcctacttaaatacattaggttctggatttgatgccatccaagtctgattttgttaagatggagctggccatgaagcccaatttatgcttaagggcctccatatagatatgttgacagattgttttatgtgttatcatataacaaaaagccaacacatttattatttacaaaggagaaaatatagctcagcacccgttttatatctaactagttttgagcccgcgcattgcgcatggattctatgtcaggtaattgatcatttgtttaagaaaaaaaaattatgaatagcaatataatcaccatttaaattcctgctatcagtaacagaaggctttataacctaatttatacttgtaaatgagcttcattgccattctttaaccgtacaatgcttttatttaatgctttaaagtgagctttaaaactatcctttaataacataatgttttcgcttttagctagtatggtattgtaggttgattttgatctaaatggtatttatatgtgagaatgtattgtttatgtagataacttaacttgctaatgaatttttttttcaatttttactttcatatatatatattaaattatgttgcctgctaaatcacttattaacatctaatgctgacatttgaaaggatccattgacaatttatcataaacaagaaaatatcagcaaccattaagaaaacaaatgctaacagtcaaattatggatttcatatttcatatttcatgaggcagcttgaagtttgcaaagatcagtaccgtttgttgcatggagtaaatcaattatatcggtctatgatttaaaataaatattaaataaaaatatatttatagagaattataaaaaaataattataaaaaatattaaaaaatatataaatttatttaaaaaaaataaaaattaaaccttacaaagatacctcacaaaagaatcttcatacgcacaaataatctctattctaattttcttcttatgtctctcgtacacttttacatccaaagaaaactctaatgattcttttaaatagaacattatatagatgaaagtttaactcctattttgattaaaaaattaaaaatttattaaaatataaattttaataatttttagaaggaaataattaaatggagtaacattggaaatagaatcttaaagttattaaaactaatcatcaactaaaaataaaattctaaatgaattgagacttgttgatgaatctcggcaataatgtattgttatggtgctggaaaatctgaacctaattagtggttaatatctcaattcaaatttgggtcttaaggtattgagcattggatgcctttattccttgttggatctacccgaggtccaatcgtttaaacccatcatcatgcctaccaaaagcttcttctttggggacctttagagccacaggcatcatttttaattttttttaagggtaagaacccacaggcatgtttaaagcgaaaggatgctactggagatcgggaaacacagaagagttcatgttcatttctaaatttcgaccgttgctgagggaatcatgtccaacgtttcgaacgttggcgcctgctttatattaaaggtgcctaaacattctgttagcagtacaatgcaaggttttgggaaagaaatttcaatattataacaccaaatggagcaatcatgtttagttgatgtatatatacaacagttgttttttgattttttcttttttttcttttcctgacttgaaaaatacagaaggaacggaggaaaattaaccgagtggagtaacatgaaatattcttaattagcattcttttgtagaaaatgggcaatgactgcttcatgatggaaaatgtggctgttattgatccttttattgttcgccagattgagaaagtataattttagatttaaaatcttcatgtcacttaaaaataatatttacttatatttttagagagaaaagtaatcaaacaagctttatcatcaattatttttttttctaaaaatgactaataattgatggattagcccaactacgaagcagcatgcataaagtcggacaaaatgaaaaaatatgtgacacacacatttttgtgcgtgctgctttacggatggatttgtccgtcggctcaacaatgaataattaatatagtcgaagattagattcgatcgataacagttatttttttattacaataataaataaaaaatttatgataaaattatcattagaatctacatgaatctctaggcccttcagctgttcataaccatgcaaaaactccactaattagctcacatgaaagcatcaagatccacatgtagagaaataaacctagctttccacactgagattatataagaaaaattggaattatataaacttgtactattaactggaatcatatttaacaaaatcacacagttgcgaggccaacctgatgattggacagtagatacgtaatttgtacgcttaatctgaccccagagatgatggcctttggccactttggcccttacaaaagggaagtgtgacttgcctttccctctcctttttctttactctttaataggcttccattttatgctgccacctttctttgttctcacaagtgaggataagattcctgggccagtgaattatgaagctttgcatgaactataaatgatcctgtgcattggagaagaacgaattctttggcaatcttacaagcctagccttgaaagtaggcacatgaagtaaagacaccaaaaagggaaaaaaaaaaaggacctcttggtcccatatgtcaagagcatcatgacatcccattcagcatggcatatccctctagccatgctaccttttcccccatgcatgtcctactgatgattcaatcaaaaataagaaccagctagcatcatcaggtgaatagacatgagaggaatagccacctttttgcatgcattgtgagcaatgaatggatcaaataaatggaccattgatatctaccctggagaaaaatgaacaggctccatgcacaaagaattaccttatggagtgcataaagatccaagttttgagagaaagagctgcatgtttaggttgttttccctacaaaataatagagaagtggctgcatagatgaccattcccttgctaaaacttttggcacaagtagaaaagctctaaaacctcacattctcccaagataatgaagactggatcaggagatgctgcaagcttgccatgacaagttttcaaaaatataaggttctggacataaacattatggctcatagcattgacttgcatagcagaagctaagagacactaacaataattaaaacatgtggctactccattggtcttcatttttcttttaaatggttggtgcattttgaacttatacagaaatttaaatttggaaatcctttattaatcaaatgaatcatgaaaaagtctagtagctcctctgcctaatgtataacgaatttataataaaacaacaactaaattacaacttaatttaaatattggccacataaatgtatgtaaaatagtgggtaatatacaaagagaaatggtgagtttcagttgcctttttttttggtaaatgccaaaacagtatttgctgatcatcatatcaccgagagtagaatttattggatcaatgagaacttttctaatgcaacgtcaagaatccaaccctgccgacactaaaagatcaacagtcaagacaacacccttcaattattagtacttttattctaccaaaaaaaaatatatacttttagtataatttgtgtttttttaataatatatggccgtcccatccaactccactacgaacagaacgcatgttatgtgatgcttgtctcatgggtcactctccttttagggggtcattatcatggggatcccattaaactgttggtctaatttgtgccccaacaaagaaggcacaatgataaaatataagaaaaaggttgctccattcagcaatgcttgagaattaagatgcaaataggaaggaaaaaagatagcacttacatactgctccatactccttttgttcctagaggtggcattgttaggtcaatgtggaatccaggaggttggggtgcttggtgttatgtttgttttgtgcttgtcttcaaaaagtgtaagaagaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctaacgccatcacggttttttgtttttatttttttttaatttgtcctcttcttccaaaggaggaacggtaggttgacctcgttaaaaaattaataatgaggaacgcactggcattgagttagagatataattcatgaacttcatcgaacctggctctggattcttacattttttccgttaggacagatataatggttgtatggtggtttcggtttttatcacaagaggaaggaatgaaaagcagtacttttggatgttatccgcagttgcgaagacaacataaaattgtcaagtgtcaagattaaagaaacttttagactatgatgagcatcacctcatgatgccactaaatcatagatgtacccattaaaaacttagattccattgcaaattttgtttaacctacaaaatcacatttaggaggaaaagctaaccaattaattgagataaagacatagaggacttgtgagaatttgtattttggtgctaaattaattctaggaggaagtaatatgtgaggatttgtattttggtgctaaattagttctaggaggaagtaatatgtaacgtattttataagaaaaaaaaatcaaccagtagatcactcattaacgtatattgcattcaaaatggaggggaaaatcatcaataatacacataaagtgttatgatctccatttttttcgataaaactatgaaacttattcaccgtcgactttattaagttatctctaaagttatttcaagcaaaacaggatttccaaatattttacaatttaatatcattaacgaaattcaatcattagcctctttaatttgagagtttgggatccacatttgccatagagtaatggtacatgactcctgttatgtgcatacatggcaagtggagattcttgtaacttgggagacttgttgccaaaacatgtagcttcaattaattatgtagctgtcaaattaataacgtagacctgatgaagtttttgtgtgccatatcaggcatcctgaagctttaaactcaaataaattgtgaattggatataaaaaggaaaaaagaaaaaagctggttcacaatatgagccaatctaataagaaaaggtgaatgaattaaaataatatatatatatatatgcaataatttatttggatagttcttagttttgctatttcttcttgagtttgtacctcaaccggagaaggccggttctccaggaacatacatgggccagtggatcaacagggcccattacggtcgtgccgatcactcatagacagcgactgcccaagaaccggccctctccattagaggtaggatcccagctcttcttccaatgtttgatgtggatttgagacatgactaaataatggattcaaactttcggttttaaagttagcatttcttgctcaatgcatcccttcatattggcaattgattctttcgtgggccaacctgattccccacccaattgtttaaaccaattgttgtgccctattgattcttctttaattaaagccctagggcagcttttacaagcaaaaagcttccaataaataaagcactagaaaatagcgggccccagggatctaaaaaagtggttcactcctgctacccaccagtaatctagagtcgaaggatgctttatggatcaaagtctcaaccaatgggctagcaccagccacagcagtagataatgtcccaaactttatacccttcagctgtttgtaaatccacttgttcaaatggttgcattgaaggagttcaattccacatggagcaaacctctaataaggattgagattatcttattataagaatgtcaaaggacacaaagattcaattagataagaagtgtgactaattcttggggccttgatgcacagaaaaggttcaccatcctttaggaggcctataaggaggcgccatacataaagtcaagttccattttctgtgctctcctaggcttgtgcagtacaaggaagattaagaatctgggccctgcgaggcatcagatttttcttgcatccaacagtcaacagtatgaagcaaaggactatgacaatgacagtggacacagactctcatcttttcttaaagaaaacgccatggcgtgaagggcatcagatcgtctgcctctgctcacttggctgaaaagatgaagtggggctatattaccttttcccacaagaactttttggaaggcttttgttcaactagctaccaaagtttttcaggttaccaacatgttctctttgttgatccaccattagctgtctcaccattgatatccaacttttcttcttatgttaggccattgtttcagagtacacaaatttacacacaagggagcagaatgtaagatagaaaaagctagagatacatgatagaagagttttatgaaacttcatacagatacagatagaagcattattctccacaaccaaagtgacagatcagaattagttgacctcgttgctgctatcttccttcccacctttgaggaatctggaaaaccagatggctgatgattttggatgccttgcaaggccattcttatagtcaacatatatcagcccaaacctcttggtgtatccttgtgcccactcaaagttatccaacaatgaccatgcaaaatatccacgaacatcagcaccatccctgtcccaaatacattagattagttattgttctgtgttttattgttcatttcctaccacaaatgcacaattttcatgaaacatttatatgaagaaacggctgtctaggtacaactgaggtcacaaggacatgcatatgcaacaaacatattatacagagaaaatgcaatgaacataggtccactggcaaataggccatcacacgactatggtaggtaggtcgaattaggagatgtgtacaacaacaacaacaacaactagtcgggcatttaagtatatgagggcacagataaggtgccaaacttgattcgaatgatttgcaaggtttgagattggatgaaaggttaccaggagacaccttggtcccaaaattcatggcaaatcatccaaattactattccaatgggctgcatcattgccataaaaccaagacaaaaaatgttgcaggacgtaggttaccagcagcagcagtagcacaataaatgattaggaagcaggtgcaacgacaaatttccaaagatattctaaagcagatgagctactcttaagtggaggactactgatgttctttcaatttacacaattcctttggagacttcagtcaacaatgtgatataaacattgtaaatgagataatacatatggcctttcatcattttgagcattttctgtcacctagtatatattacaaggatatgcagacaacagtaccatagcaatgcatagaaaaaatataatcatcttcataaattgtgatatgatgtaccatgatagcataaaaatatcaagacaatattaattagttaggctgcggttgaagggttttaattttaaaatcatgattttgtcccttctcttgagtcaaaatttctaatcctttaggagttgagatatccaaaaagacatgttgctcatcttaagggtaaatttttaaaagattcacataaaagtaaaagtttctaattccaggataatgggtttatgaattttcaaaatgcaatataaaaaaatgcatttttatgtcattactaataatctagaaaagcatgcaacatgacaaaatataaggttctgcaatgcactcagcaacgaatatacttctcatgaactccttgctgaaaattttgcctgttattacagatctcacactcataatgcttccatcaagaggcgtcagtttatccttctcacatattggtgatttgcaagagtttattttttatcttcctaccagaactaactgtcacataagtaaaatgatttaaaagttcagaatccaaagcacacatttatgtggtgctatcaatctgaaactagtacaggaagttaaagcatacatgtttagaaaaactacagttgtaatgtacctgattgcttgcgcaacagcagcgatgtaccccttaaaatatccaactctcttttggtcatttaaggcctcattcagtgctgctgtctcaatgtcttcatcatccatacctgcaggttatagacaagtagcccaatgaatacatatgtgaccataaaaagaattcctttttttaatattaactgcacacaacatttataacacttgaatcattattcagcatgtatttcaagcaaaataaattagatccctattgcaaatgattcatatcgccttaaaattttaaattttcacaagaatactagacttggattgtctgcagtcctatttgtgagtgcataatgaaatgatttccattaaaatcggagacatcttttacggcttggaagagtttggtgtcaatccctttcaataacgtctgaaatttgtaaatctatcaccaactttagaaaacatagggaaaaaatatccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatattttttcgctatatagttaagaactttacggatgccccaaggaactatgtaaagccactctgatgcagcctgccatgatagaaaattttccagttagtttgataatgtcagatgcattttgaatgtttggtttcattgtccagaaagctttcttagaggatgcttgtgcatgtgatgtagacatgcatgcacatgtgcatgctcccacaggcgcacacacagggaggaggggggggggtgtggggttgtgtggagagagagagattcttaccctatcaccaattgcctcacctgcttcccaattagctgtgcataatacaataaataatactggtcaaactgaagctttattgaaataaatgcaaaagttactgcgagactggcaactaataatttaatatagggatattcagaaaaaaaggtgatttgcaattaaagaaaaaatttataatgttgtagatgatctcatttcagagaattagtgatcaatctgatacacataagataacttggcaacatagtgtttcattgaagcataaatgaatgatttagagaataaagccataaaacaaggtgataaactattttaaactcacaaaatcatagaaaatagcatttcaggaactaatttatggatgtacataaggcagacgattgattcaattctaaaccttgtgatcattttagatgacttggattaaaataaaggcaagtgtgtggttgcaaaccatgcaagtaataatgaatctgccaagtgaggagaacatgcaattggtagcataatagcttaaatatgagtatcttcagataagaggtagcccatatgctactgagttcacaacactagttgataagtttgatcaattcactaacacagggacatgagcacaataaagcaacactatccttaatgaaccaaatagatagagcaagctgcagagagcgagatggaaccgaaaggagtaacatgatgtctgatcagggaaaatgcttatctttgggagaggatgcaagtaggtgctcaactaatgttatcaaagtttccaggtcaattgccaacatccgtttgtgtgcataaaaccgcaatgcagaaagaaagcatataggtgaattgggtgcacctgcatgtcctcatgtggaagatatcattgtccaacaataaaaggattcacatggcaaagtttgaaagatgtgttacttgagccatttaatttagattgtagaacttgatctcacaaggcaactgtcctgaactcaaacccaaccaagaaagagcctagaccactcagatgagtcaaccaggccttgtagcaaaaaattagatgctgatgctgcaaaactagtaagaatttagtggaattcaagatagttagtctgcttgatagcgtcttcaggaaatcaaactggagatccattcagttgctaaggatgaaacttctttgacattaagtgccatgttatttcctaaaaaacatcagcctcatgttctgcccacaaaatatataacccaaataataatgcctaatgaacttgtacattttcatttgctagccctttggatgtttcaatgtgagaaatatgaagtgatgaaatatattaacttatataaaagacatcaagccagaaagtgacaagcccggatagcttgcttctcttgctacaactggatgagaactgtaccattccattatttcttagagaaaccttcaacttcatgctgcaaataggaaacgatgattgaggttctttggagtttagagttgattattatcaggtttgtaggtgagtgcacattgaagaactgcctttttttttgttggcttgctgtgtcctgaggacaaatttgtcaaaccagtggaggtgggttgatgagaacaaggcatgatattttcatacatcaaacttcttgggcttacaaagtattctcaaaattctattgaaattctttcatcactttcgtatactgatccaacactactagatgaatctagcctaaataataaaacagatgtagagacataaacaggtatataaatatatcaatgtttcaatttcaaccacaaaacaaaaaagttaggaaggtaagcatataaatacctatcctgtccatctcttgtacttgataaaagtggatttcttttgtattttgtgtatgagcaataaaccttgttgtgtaatgattcaaacccacaaaatcaagcgaattccttagcaattctttatgtgcatctgagaattttggaagtttatctcctagtctctcatgcataactgcagggtagttcccgaagaaaattggatccaaaaaccttcaagaaaggaaattttcagatgttaaagaagcacaaacccttgttatattgataattacacacctcaatatttaaacaaggcacagaattcctgtacatataaaaccttgaatcatcaagattcaagataacagctaggtaaataaagtcttagaaatagaatgaacatttgtatctttttcaaaatgaatatgtatataaacatgagaagaaacataatacatctaagataagatcaaatctgatctgaaaacagaacaaagggataaaaaatgatcacaacacctacatactgctctggtcaatggctatctaaaaggtcttaggattgcatctttaataacttcaatataaaaataaggatatgttctaaagatatagggtgaaagcaatattgacaagcaggcatggtgctatgtttaatcaggaattagaattttcacagaataaaaactttataatgcagtctggtcaacaaacaacatgaagtcgaaactcttaaagggaccaagagatgaatccaggaataacttaaagaacttgaaaactcatggctattctatcatttctttatcgaatagcacacgcacgcccacatatttcttgtttttcgataagcatcgaaaaattggcttctgtttatgtgaacttatattctttggaggctgccatatctgacacttcaggagtcgaggacacttggatagttggcatgtcatgccaaaagtgtccagggaacactagttctgagaatggcagtccttaattcgatggcctcatgaatcgaaggtcatttaagacttctagttgcatttatagatggatcctgttgcgctttcttctacaagaagaccctccagtagagtttgagtcctagtaaattacctctagacagttgatcagattgcttactacaaacacaatcaggcacacataaaaacaagcacatacaatacatgaagaaaaaaagaatcctatgtggactaacatcatgaattaaaatcttccttaaattagaactaaagattctagagatgttatttccttattaaaagtaattcttgtcaaattatctgaaaacctcgatatataaaaatcttgaagtctggatgcctttggatgctcggagacaacacaacaacccatgacacttagtcagcaaagtttccctgcttctccctgaaccttcctacttatcatcccccttcaccaagctaacaagaattttgccaactagacagcaaaattttcaaatttgcatgtatcccaagaaattgattaattgcaatttatggaatactcttcgaggtaaggaaaaattgacaatgcttatgaggttgctggtgaaagaaccaatcttcttcagtggaagttataaagccaatgctttcacaatccacatagtcaatgttcaacatgtgtcaaacaccttaggtgagaatatgtagagagcaaaataatgctaccatgcttgccattttattgtttcttttgtgggatggagaatgagattgcttcacaatcttcatcatgacttcacaaggaaaatctggtggcatattactgagatattgtcatttgaatctgttggcaatatgctgttctagactccgaacaaaattagtaaaaaccttattttgttctgcatctgcaattaaatttttagcttggtttctaggtccttattgttaagctatgttacctgtaacttttgcccctgatattggattgtttaagtcacatgttatgtttgtctttcatgatatacaacaagtcacaaaaaatagctgttgaataagaaccacaactatcatatagaaaatggtttgttaggaggaaaactaggatttagatgtctctgtttctactcttcctttaatcacagaaacatgctctaatagtgattattctatgagctctctatttcctgagatgtgcagaaggcattaatacaaatacataaacaaactcttaccaagaagcacaagcagaaggagaagaagaagaagaagaaataaagtcaagactcaagagtatataccagccaagttgaaaatccagccgtctctctgcagctatcttatcttgcaatttatcagaaaatgcctctgcccattcacaatcgagaactaatccaacttggccaccttgagtagcctaaaataaagcaagtaaagctactaagccataatatgagtagaataacataaaagctggttcaagttcaaatgggatgtttctaatatttagtaaaccatcctaatttcccattgattatgcaatttaaattcaaattttgaagaattaaaaaacatggaatatttttcattcatttactaatatgaatgcagattttatgcagatagctaaacaatggatatgagtgtttaatgaccaataaagagatatttctacataatgactacaatactccataggaaacttaagccaaaccaaaccaatatatgcgagagaaaataaagtgcttaatgactaaaaggtgaaagtaagtcctccacaacgactgcaatgcaacataagaaacaagcaaaacctatatacataagataaaatatatcaaagaacatgccttaaatttcttcttgtacacagcagctgctgctgcatgggctaagagttggtgatgtgcagccaagtagggttcaaaagatgaattctcatatcttccaggagcaaataccccaacaccataaccattcacagctgtttgaagtggttcattgattgttatccagtgcttcactctatctccgaacttcgcaaaacaagtttctgcatatagtgcaaaatattccctggacattgtgcaaaatcaagtaacaaaaaatctttagaacacaaaatgcaatggaacaatatctggtcatattttgcgtcaaaaaatgttcttaaatttgtgcaagaaacatgtcacattttcaaaaggaaaaagaaagaaagaaacgtgctagtatgaattttaacaagatgctccataatagtcatgaaatgatacataaaacaaatgcatatatgcatacatagaatgccaacatgtccctatcatcaaatcacccgaggatctaaatgctgctggtgcagggatttgccagcatggcacgtactgtgcgatgcattgacatacaacatgcaccatcatgaagtgggcccactagaacagtggaattggcatgcatattatgttgtgggcacaagatttttccaggttttattttttttaaactttgacatttgaacttcgtcctagtccggttaagagttgctcacaaaattaaaacaatatttagctccacattttaaaaaactcctatgcagtacgatcaacatcttggcatatatgcatgctggagttctatgaaatatcttttttaaagtaaaatgacatcctaacaatgcattaatattaattaataataatccttgattaaaaacagacaattataaatcatataactctggatgggaaatgattggagaccatataatgatgaaggctgaagtgctctgctctaattagcaacaaatcagattaaaagacacttagacaccaaaaattgaaactttctcaccagatctttgggtctgagcaatgtttagatcaaggttcacaatctcagtactggaccccacatagctaccatcttggtataatgttggtacacccaatacaggagttgattcggcaataccggtatttggcatgccccctgtaccgcttcaaagtttggtacagcacactcggtaatgcactggtacagcataccatggtttagacgtcaaagtttgtgatgttttaagatctaagaagtttcctagcattgaaaacttgccagtttgatcagatccctaacatcgggaatctattcgagttggcaagttaaacttattttgatgaaacttgaaacgttgaccatttctatcaagctaaaacagagaatgcttcccttgtttaatgtagtatgctaagtaaatggcaataaaaaagaataaggatgcattttcttgaataatgttccttgtatgagctgttcccaaccagcaaacctctgactcccctaaggcaattaaatggtgaaaaaagaagtgaacctttctagcttagaattaggtcgtactaacctatctcgaaccagcatggctcagtgcaggtcagcagtgctccctatcgagcagcttgcatagtatgccaccccaacctagtgtcagatacctgaactagcccatcacttattggcatagtcagatgctggaacacttgatatcaactcttctaaaaagtattttgaatataggaaaagcaacttatcaataacaagcataagaggaaagaagttctaacgataaataacaagcataaaaatacgctatcaataggaaaaccaacttatcattataactcctcttataggatgttcaaggaaaatctatttttcaaactcatcatatgctaaggttgattgatcacatgaccataccatgcctcagtcaaattcttttctcaagggcttgcctatatgatggtagttgtttgtttgcagcaaatatagcaatttattctttggtctgaactagagaagtggaacccagatcagtgtcaccaaaagaatgtcgagttcaaaatttgtgcaggcagatacttagtctcttaccccaaatttatccagcatagttgtttcccaaaaagaatcatatcaaagtagcaaactagcaataaatagaacgctataaagcaacaaatgttcttcaatttatcttataatctagtttttggtcgacaatatagagcatttgtatataacaatattgaaccatgtaacaaggcagacacgtaaagagtgggccttggtgcaacaatttggttgcttcattatgacatgggtgtcacaggttcgaagcacagagacagcccctctacatgcaggggtaaggttgtgtacaactgaccctcttcagagcctgcaacagtgggagctttatgcaatggaatgccctttttagacacatagaataagaaaagtaaactaaaggcaaaccacacttatctctatctaaacttaatcatgagtaacaagcataaactcttaggtctttatgaaatatccagtcaaggagtatacaatttttgaacaaaaattgatccaaaaattacctctgtgacatgtaatactaaatcaggaatcacctaaccccaatgttgaagcacgataacatgtgcaactctcatcataattcagaatttcattccaagacttgacaaaggcatataagcaacatattaatgtatatattccctctatgtatgatgtaaatatgcattgtaaaggtactaccaaatgcaacacttgtctattcatcttaagataaagaatcaacagttagaagttgtattttaaaagcagaatttgctaataaacattttggtgttctgttctttttattttaaacatgtaatcagtatgaatagattaccacaaaatctgaagttttaatgaacaaaaaataaatttctatacaatagctatctataaggatggattatccaaatcaaatgaaaaggaaaaggaaagtgcacccaagatttctcgctagcaaaaaataaaggaacaggtcattgtcatgttatttgtcagagttatgatgaaagcatggaaaatgtagctaaaatttagatttcattgctggtacatgcaatcaactgctaacattcataacaatctaaattgccaaaaggagtttgagaatgtagcaggactaggaatacatatccccactctttagtatagttgttcattgtagcatattcagttacctaatgtgtacttttaaaagcacaggaaacacatgaacataattgcgacatgcaaccaagaaattctttccatgcctgtttcttagtgaatgcttaactgtagtcagaaagttcaggcaatctatttgaagcttatcactaactattcatgtattcaacagaaaatgcttaattatataaaacactgtaggcattttgtaatattatatatattattcaagaaattctcagcactttgataagtatggaaacttacacaatcttctcagatagccatcctcccatggactcatgaagattatatggaagatcccaatgatacagtgtcacataaggctgaacacctgcaatcagaacacgtaaatgtaggttttgctggatatatttgaaggcaccaagcatatggttaacaacctttctctagcaggaaatcaatgagattgttgtagtaagcaatcccatcctcattgatctttgttcctaatccatctgcaataatgataaaagtacataactaattccaccacagaccattatatcaccatctaaatgcatatatatcattcaaatgactacaaagatctagtaaaattgaacttaatgttgctctcaaaacagtattcctcatgcaacatatacatatacataatacatatatagatacagacacatatgtgtatgtatgcagacatacatatatcattatatgaatatatgcatgtatggagttacaatactttcagagagagactatgagagaagaatttcttgcaagaagtcgagcacaacatcatgaagatatgttgaaggagaaagaggcacctcaatttcttagggacttggaccatagatgttcctcatcacatgcaagtcatattgatctagctttcaaatttcaaaagtgcatttttagagcacctacttaaatgatgagatatgcatagaaatattacataagatcggataactcctgcaactattttcaatcatcctcgtccaatctttgtgataattttagaacacttaggccttgtttggtacagctttttgggaaaacaaaaaccactttttggccctgcaaaagtatttttggatggtatagcggtatttggtaaaaaaaatgcaaataatgttttaatatgtaatattacatcatactatactctactgtacaataccatgtaatattccttttcgtcattttgttatatcaaaagcactttatcaatttggttaccaaacacatgtcaaagttccacaacacttaaaaaatggtaaccaaatggcaaacgactttatgtaaaagctctacttctcacaagctaagccctaaaagctctactatcaacagcaattccaaacaggaccttattccttaatctacccgtcttcccgtcatatttttcaacttgttcccatgattccaaccattgtacctcttcatggtgtcctctagtctatgttggcatggctgcatcatttcaaccatatttgtaccatcttatctattatatatgtgattcccaaatcccaattatttctttatattcttatttttcaacttcccaagtcctagtatctctacatatttaccttaatcttctcattaacaccctcatcttatgagctaagctaccctaatcggtttaatatatgttaaccaaacttcattatgaaaatttccattaagcgaatacatacagcactgaaaggaaataacaaaggaaacacatctccgcatcaccaaaacagctctaagttttcaacaaaagtggggaaggaaagccttttgtctctctccaccctgtatgatagatttaagatttaaaaatagctttatggcaaatcatttggttattgattgtaatttggcttattttattcaattctggttaaagctgcatttcagtattccaattctaactcattggacaattaatcatgcaattcattcaaaaatttactattctcaatacactgcaactgccataatggaacttctaatttaaacccatattgtttaaaagatctacatactcaattagcatttgaggctttgagcacttgcttaccttgccaattaacattacatcaccaataaaatgggagtcttccaaggttccaggctttggtattataatgcttagcaatcatgaagataagaacatctagatattctagtttcatttaaacagaacatggtgtataatcaaagaagatggtgaaagacaattttttatcttgtgatcagtaaattaaaaattggaaagctcagtgaaaataatatatctaatatatttagatatacaaaatgtcataaatgtctaagcatgatcattaataccatatcaattacattatttaagataagggatagaatagccaaattatttgcatatatgacagtatatcacggtattctttcaattttcagcagactaattatcactaatacatcatccaatcattcatatgtccatccatttttcttttcagctatttttaatatatttttcttttctttcttcttctttgttttgcttacagtttctttggaaagcatagatttgatataaaagctaaattaaccaaccaaatgcaataattgtaaccaattggtgtcaacatacttataggatacaagcactaaaacaagctacttccaccacatgtcacaaaccagccttagatcttttgtgctttaaaataggaaaaaaaaaacacaattttcaaagtatgtaaaccttcagtttgacctaggtgcgactgggtaaagagcctatatatggaaataaacctctcaaaaagtacagtatttggaaaagtaataaactatcaaaaagtacaacatgccaactatgaagctgcaaatatgatatatagtgttttagataatgattacaagatatcatagtgtaccggggaatatacgaggccaagatatggaaaaacgataagctccaaaacctaggttggcaatgagttccacatcttcctgcatttcaataaatgaagtatcatggaattaaaacaatgttacaaccaagttcgagatgataaaggaatagagaaatgaaaacacatttgcaatgactgctaatggtataaacacttggattcacaaaaggctaaaagactttggtcatacattgtccaagatggaaatgggatatcaaatgatgctacatgccaatatttggcaactgggacttgagaacttatttagcttatgcttcagcatgttgataaatctcgtactgagacattttcaagtatttcttcaataagattgtcaaaatgactagatagtacacattaacagttctatgcatgcatacagattatttaatagctaagcagttaatgcatgataccatatgttaaaaataagcatttataaaataataactaaaattttgaactattgtatgtaatgtctcacatagttgaatttgtttgccaaccaataaacgcacaaccccattaaaaagtggagaaaaagtggtggtcctggtggtagcagaagaagcaagacaggcaaaaaaaaaaaaacttgaaatggctgaaaataaagaacaatcttatatgtgaataggtattttgaataacaaagagaaattctccaccttggttaggatttccaagaaaccaaattgtttagtttactctgtcggcagtaaccctaaaatggtagctcaattgataagaaacccaactgaaaccggggttccaattgttcaaaattattttcctaatacaaaatagaattgttctttcttttccatttcctcttttaatgtcattgatgaccatctccagcttttgatttaactatcaattccatacttgcttcagcatatagttaataaggtatgtgaaacaaaaaaaattagtcaaagagaacaactcaaagcaatttgatgcagtttaggattagggaaatgtacaatttgagaatataatttgaatatttttatttttagatctaatgacaaccataactaatctagaccataacttaaaatacccatatgacaaacggttaaggattccaatgccaaacaaatctgttgatatgttagaggcaacaaatgggcctatttacaccgaattatcatggcctgaatgtatagtgtggagataaagaatgtaaaaatgatcctcttttatttttttcgttatcagtctagctcaagcgttaagttccatttttttaaaaaaaacactttagattaaatcaagatgtttgaggattgaagtcattatggccagcacatggaaggaaaggccattcccaagagaatgaagaatatttaagaaaattccagtcacgttctcagttctccctttctctgttgcacattgaattccatgtctacagtcagtctttccaggctcaaggatttgctacaaatgtgtattctgtgaaatatatctcttctttctgttttgtcgagacatggtctaaaaatcagatcaatgcttcttgtaaatccaccaccacagttttgaagttcatgggtgaaaaaacatcacaacattcatctgcctcagttagtattacaacctcgaatgtccaaaatggagcatcataatgttcgacctgatgacaactgtaccaatatgagaaggtcccacagagtgaagaatgattgaagtcatcaaccaagctgtcaaacatttaaatgggtaattttccagcttggagaagtaggtggaagatctcatggtgcacttcaaggaattcatggctcccaccagggaaaaggatgcacgagtagcagatgaagtccataaaccagaaagatttgtcatctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttaggctccaatatcacattttataaagattaccacaacatgatagagtgtcatttttataatttgaacattttctacttaactggagttcaataaaattcggtgctaaagaactagcaaaatcagaagtaaaacctcaaaaagacactgaactttccatccttcaagcaaggtaacatctgtcctactaatactaagagatttttctgaacagaacaaataaaccatcactcctttttgaagattaccacttcagtaaaacataagaatcatcgatcatagtcacaaaaaactaaaataaaatcatcagttgtactaggagatatggttttaagtcccgacagtatggggcgtgtcactgctctcccgtcttatttccatgagaaaatgggatgggtataggggacgggactctgaaatccatcggagaaaaaaaagaacgaggacaggaatagaggaatgaaagaagaagaaaaggaaagaatacataaaaggaaaataagaggggaaggaagaagaaaaagaaagaaaggaagaaaacaataaacaaatgaaagagaaacaacaagaaaaggaaagaagaaaaagttaaaagggataagaaaagaaagaaagtaaggaggaaagaaggaacaagggaaaaaagaacaaggaggaaagaaaggaagggaaaagaaatagaaataaacgaaagaatggagaaaggaaggaaaaaaaaaaagaaagcgttaaagagatggagggtacctatgggacaggatagaatagcggggcatcctattccatagaaaaaccaagacagcctaatctcacgggacttataatcttgatacaagatataactaatgaagaaaacttttctgaatggacctgcacgagaacattcttattctaacttttactccacagtgctctctcaaagatatcccatctaaacataggcaaatttgtaatatttaagcttcgctcgattttattcctattttcgtttttgcatcctctcttctcaaactcgccaaaagagttattctactagataagccagctttctttctttatacggaatcaacttatagatattagtatttaagttaaaaattattaactccaacatactcattggggaacccaaaagatcacaagtgagagagagagtcaacattaaattccagcatttccattttttcaaagaaaggtatcagctttaaaggatttttctataaatgtgtccgactgtccgctgatcatcggcacagagacctccgcaatcagataaaaaagcaatctccaaaaaagagagcagaaccagtttttccgatcaaatatgataaaaagccatgaccctctctgaaaacctataagaattccacttaaatgcgccaagaaaaatcaaaatgagcagcggatgtggatggagttctcagcgctggtcttcatctatacaaggattgaagctgtattggaagctctaaatcccagaacgagcaccgggtattgtcaagcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatcatttaagatgcatccagagtttcgcttcaagaatgaaaatttccacgaaacaaaacaggaaacagatcggaaagagtcatcgacagagaagtaagagtagaagaggccattctcctcctctgtttcacctggtaagccgaagtggcgactccgaagacaaagccctccgggaaatcgctccgcgaaacctcttccggaactccatcgcatataccaatccttgcggccattggagagcaaagtagcagagaaaaaccagacggtacagcgcgatcctcctcccgccgcgggtagttggacccggagatcttggacgctcgtcgccacgaggccactcttaaatagacggagcggacgagtgtgaggccaatgtgaggccgctgcgcggatgccaattcgatcattattcattggttagtaatgaacggtttcggtttcggtttcggtttcggctttggtttcggatgttgctcgttaggtgtcccgtatttctgccgggaccaccaatatttgtgacgcgtgtatgacaggtggattgacaggtagattggtccgtttctggagtgcgcttgtcgagttctccgaagttttacttctgcggcagaactgacgcgatggctgacacaaggaccccaaggtggactggttggtaaggaatctgccggtactttaccaaataaaaaaatggaaatctgccggttagctgcctttgtttatctttccctctaaaatatatatatattttttgtttagagatcaagcatggtgccaaaaatacgaggttcattatcatggaaactaattaaacctcctactattaaaatttattatattatcaaatcatattttaaaaataagtggataagaaaaaaaattataccttatatattgcaagaggccaatattaatgatattgatattaataattaaaatttctatattgagatttaatttgtacagaattcttcatttgtaatacaaacatcgatattaatgataaatatttttatttaatattatattattaaaaaaaattaccaaaaatataataaaattttttaaatattaatattttttaattattataatttattatattattatattgtattttattaatgattaaaaattacaaaactagtattagaaagcttgatgcatcaaagatcataacgtattggaattcaattgacatcaatatcatgcaataaaatatatattatattatttgatatataattaaaaaatatttgatggacctcttttcttagatcatacaagatagctaacctaacctactattttttatcactatagcatcaattggatcccgtaactttcaacaaataaagtgaataatatattggtgaaaatgatatgagattgttagttgtccattacagttggtcttggaattgaaccaaattcttttatatcatataaaaaaatttatgatctgaccaacattgattatataggatatgatcctatttttaacaatacaatccatttaagtgggttctactctttcttcataactcacaaacattcgtgacccaagatcttctaagatgcatggcttgcactataaaataccgtgcaatactcgatggccaccataaagagatagatggctatcaaaaaagttgcaccatggcacataaggttattttgtttgatacgcatccatttttttgatgatagccactgggtattgcgcaatactcagcggtgcaacatatgaaccgtagaggattgggcccaagagtcgcatagagttcatgggtcccggggattaaatgcatcctatgtctaccacctattaatagtacttttttttaccaaaaaaaaaaccattattacttttcccaacattatcaacatttcacttaaagataagaagcaatgttggtattgaaagtgatcaatgaactaccaaatcatgactctatttctgcatttcaggagaggaaatgagaggattagatgttcattaagtccacccaactttgctcctagacatgcaatagatgattgacatgctaatttagcgttatatataggttacacaacatggtgtgtttgtaggctttacctatgaaaggtgcatacaatgttgatttgaagcatacatattttgggatcatggtgtttgtgggggctttacctatcaaagctacatcccatgttgattttaagcatacatggtttggcattatatgttacacatcacagtgtttgtgtaaactttttacctatcaaagctgaatgctatgttaattttaagcatgcgtattttgtcattatatgttagtgtacactttacatatcaaagctacctactctgttgattgtatgcatacttacaaacttaacctgtttctaattttattgagataataaaaaattaaaccttatcaactagtatgcattatatgttacatatcatggtgtttgtgtgagctttttacccatcaaagctgcatgccatgttgactttaagcttgtatattttgccattatatgttagtgtgcgctttactataaagctacctactatgttgactctatgcatacttacaaactcgatctttttttatttttatgaagaaaataaaaaaaataagtatgtggttagcattaattttaaaagttaaccttattagctagtgcgcatgttatgttatatatcgtagtgtttgtgtgatctttttacccatcaaagcagcatgccatattgattttaagcttgcatattttgtcattatatgttagtatgcactttacatatcaaagttaactattatgtggattttatgcatactccttagctcaacttttttctatttttattaaaaaaatttaaaaaagtaagtatgtgattagcattgattttagaagtcaaccttatcagcaagtatgcaatgatttgatttttggatggttcatctatgacattatagtaccaagtcttccactttttctctccttcaagaattacttggctagttaaagaaactacaattttattgaccaaaagagaaactagaattttcaaatattgcctgaaagttaaaaataataaaaactattatacttgtgtataaggttcatcgagttggtattgaaaatcatatctgcagtgattggttcggtgtagtatagatccatattgtgtcattccaggataaatcataaaaagaagagccaaaagaaaaaaaggaagagggagaagaagagagatgaaaagaaagataggagtgaagagggagaggatggaaggagagagagagaggggttaatttgagccttgtaaaggaacttcaagaaactccgaatttgacaagagagagagagaggggcgaaagaggtcatgagggaggggggagagagagagaaattcatgcactacaaaatattcatgtattagagatgactattagcgacggcaaaaaaaccgtcactaatagcactattcaccgacaatatattacgataaaaaatctttcgatcgttaaaaattgataaattattagcaacagcttaattggttaatagtgattgaaaaaccgtcgctaataaactattgacgacggctttagcaacagagggcatgctgtcactaataaattaataagtttttaaaaatttgactgtaatcttagtagcgatgaataattttatgagtgatggtgttttgctgttgttaataatatcagcgacggtaattttaccagcactaatactacccctatttcacccctcatccaatttctgacttttcactttttctcttcccccctctttttcctgcctccggtccccccgtcacccctctctttaccacgtctctggtccccctctttctcccattgtcgaatcccaccaccccgagcctccgaccgtcggatctcgttttctcgagcccccgatcgttcgatcccatctttcagagcccccaaccacctcccacctcttcgagccctcgaccgttggatcccgccttctagagcctctggccacctcctgcctctctgagccctcgatcgagagcccctggcctcccgcctccccaatcccccgaccacttccctgagcccccggccaccttctgcctccccaagcccctggtcacctcccgcctccctgagcccttgatcgagagcccttgaccacgagcccccgaccgcctcttgcctctccaagccctcgactgcctcttgcctcttcgatccctcgaccgcctctccaagcccccgatcgagatctcccaaccttctcccacctcttcgagccctcgatcgagagcccccgaccttctcctgcctctctgagcccccgatcgcctcctcgagcccccagcccacctccttctgactgccttcgatccccttctttcccctgctatcagatctagcttcccatagccgtcgaccacctcccctctgccacctcctcgagcccccagctcgcctccctcatttttcccccgcgccttcctctttcccccttcttcttctcctaccgtgcagtgtcgtctcctgctgcacagcaccacctccatgctgcatcgccgcctccataccgcagtgccatctttatgggttaggtgagtactagcaacggcgacatagcagtcaccaaatatcattgttttaattttttaaatattttttaattaatatttataagatttagttaaattagatttaatatttaaattaaattaataatatttaattaaatttagttaaattagttttaaattaataatatttaattaatttaaattaataatattattaattttaatattatttttgaaaggtggaaccactccgggaagctctccagcgagcctggaccaggacatggtttgggcctaattttttttaaaagcatcgggcttaagcccgctccgaagctcgaaaaaaattttcaggctgggctcgaataggggtgggaggctcggggaggctatgataattgcctgtgcgagatgcacctaaagagtctaaagagagatcgatagaggtgatgcatttctgttcttgttgttgtagttacagagcaagcttggatagtctgttacatcgtagacaaccatttgcagccatctcatagttaaaagtgcaaagaaacttgcaatgccttattgttcaatggcagatctgagtcttcttcttttcctctttttcttatttattttattggtctctgatttaagtactatttttaagtttttattttatttttaaaaaaaattttcactccttgtttgcagccttcttactttgcagccacctcatggttcaaacacgtctcaatgggttcgggctgggctcgggcctgggcctgagcatgattcgggcctgattttttctaaaatcattggacctaagcccgcctcaaagcttgaaaaaaaaatttggacggggctcaaggaggtgccggagactcgaggaagctatgatgactgcctatatgagatgcacctaaagagtctagagagagatcgatggagatgatatatttctattcttattgttgtagttgcatgacaagcttggatagtctattacatcacggacaaccgcttgcagccaccttatagttaaaggtgcagaggaacttgcaatgccttattttccaatagcagatttgagcctttttcttttcctctttctcttgtttattttgttggtctctaatttaagtactatttttaagtttttattttattttttaaaaaaattttcaatggattcgggtcaagcttgcatctcctagagtcatgatactttatctgaagcatttgaaagatgtgattttaaattattgtaggtaaactactttcaagttaacatgatgaatacaagtgtaacatacctctggaggtggcaagatcggacatcaactacagcaagttgatttctaaccatgattccaaactcttttgcatacttatcatgaaaaaacttgtaatatttggactcgagatgtacacttgaaaggtaggatcaagtcaagaaacaaaaatgattcaaacctctaggatattgtgctctctatcttgagggcgttcgcatgtaaaggtcaatattttagttacttgtcgctcgtttagctgagctcattgtcacaaccatcacagtaggtaagttaagtagttgagctcgttgtcgctcattcagctttaaatttttatatttagaagcttcacataattaggtttaagtcagaagaaggagatatagaggtcaaaatcaatcttcctatttgatggatgggatagaggtatagatatatccgtattattaaatggacatataggaacaatccattcgaaaaatgaaagaatatattaaaatatactcctccatttcagtttagacttgagatagaagggatgggtacaagggggtcaaaatttaatttaatcatccgatggatggctcggaaggtaccaaatatctgaaggataccaaacatccgatttatgctcctccacttacgatgaacttttggatctttgactcattttaaatacttgtcttgcattgccaatcatctgaagggtaccaaatatccgaagggtaccaaacatctaaatactcaaattaacttttatacctctatattcttatagttaccttactatttttcatgatgatgatccaaactaaatggatattgaagggattgactctatagatttctatgatctctttttttttctatccatatgatgtcttaaagctaacaaatgtcgaagattagattttatgaacatatatacttgactttgttcaactttatttatatatactcgattagattttacgaacatatattacttctttaacgttatccttgatctgcggcagatggcttttcgaggccagagtcgtcccagttagagttgtcaaaatgggccggcccaacccagccctagcccatgtgggttgtgattatgggggccaggctgggcttgacccacttgttaaaatgggttgtaaaaatatagtccagccctagtccacatgggctgtgggtttgggccagaccagcccacttgttttttcttttttttcttttctagggcatggttcaagtcatcggggatgaaggcaatgtcgaggaggatgatgtcggggttgatagggaggttaacgggctcccactcaaaaagggcagtctcgccaacctcgccgacggcagctgggggccgatgaggggggccagcgtgagggggatggaggtggtctgggctgtgaaaaggacgggctcatccgacctcatttgcaccggctgggggccgatgaggggcctagcatgagggggatggaggtggtctgggcggtgaatagggccggctcatcggacctcgtcgatggtggctgggggccgatgaggggggctagcgcgagggggacaaaggtggtctgggctgtgaactggcgatgagtcttgaaagtaggggaggggagaaaggcatgggggaggagacggtggctgcaccatttcaaattggactaggaggaggaggaggaggaagacaaaagggaggatttgagaaagaggaggtttgaatcggtgaggtgaagccgaaggagaagccgagaagaaaagagaaaaaaaagtgggttggcccacaggctgacccagccttaacccgattcagcccatgggctatgggggtagggccaaaaagctcacttgcaaatatgggccagaatatctcagctcagctcggctcatttttagggctacatgggttggcccattggcgctagcccattttgatagctctagtcacaatcgaggagagagctctcaagctgccaactcgcattcttctgcactatacgtattacgcagcaaattctgatactttaaatatttttttaatattattttattctttattatctaatataatattttttatattcggatgatgtggagtcaccagtgaccccacagtcacacaaagccgcatccgactctcagagtcagatgcatggtagaggatctgtccggctcgcggcaccttcaactcgatcggaggataaacagctcgtccacattcagagccgcacataagtactatatatcttcactgaatatatttaattttagtcactttaaagtctaacatttattgttcaaaataaattttgcagcgcatttacagagcctggggtgcctcgtatggttaccaatatcatccgacgattgatgccagagctagtgaatgagttctccagttagccattgggggctcgtgatgcagccttagagatattcctgataaatcaaaaatatttaatttttaaattcatggtaggtttgtattctatttattaatatacagttgcttctgcttacagaggtactatcgattcaagactcctcaagatgaggaagctgaccgtcggaccttcaaggaggtggccacgtagaggtttcgggatggactgtacaacctttaatagtctgctatagaatacttcagttttgagttaccatcggactgaaaatcttacacagatcattggatgcagacggatatatgggaggccttttgcgatcagtaaagtactgaggagtactctggtaggtagcaaagggcacagcagaatcggtccatccagtagcatccaattctgcatactggcggctccattggcatacatgttatggtcgatagattgataaaaattctatccttaaattaattttatattgaattaatcatatatatatattaattaatttaattttattatttatttattgtagacactgtaattgaatcgtgtaccaggacagctacagatatgggaggccacacatcagtttaaaagaattgatgattacttagatcctcattctcgacagatcgtgataacaacttaaaatattatttattaagtttttatatatactgatatatctagactaatgaatatctaaactatatagatagattatacagagtatctcgtattactgcacggcaaggatccgtcctctcagtccttctttgacctcgagggatggctcggggccaccggaggggtgagtaggagttggtccttctttgacctcgagggatggctcagggccaccggaggggtgagtaggagttggatcataggattcgaccatagctgagaccctccatcaactcgaggatcttcatcgacgtcctcctctcagagctcaatgatccagacgtgggttgacgcacatgatggcagtagcgacaaaatcatcgtcgctaataattttttaataatttaattaagaaaaaaaattaaaattattaatgataaatttttgtcgctaataccgtcgctaattatctttattagcgactgtatttttaccgtcgctaataatgataattatcgacgaggttatttctgtcggatttttagcaacggcaaatcgactattagcgatagtaattagccatcgctaatagtcttttttcttatagtgatttcatcatggatgagcttttagagctccgatcctgtgatgctaaccttacacgggagataaagaaagagataagaagagaaagagagagagacttacaaggttagggacctcgtcgtcatcgtcatcaacttaacgagaacaaggattagggtcttgaaaccaagcaaagctaagaggaaataattcaaatatagaaagagtggagacaatacataataaatagagagcatgaaccattctaataactaactagtctgattttggtacactccgaattggccagtttgacgtaattcgactaaccttgcttatgtatgcaagaaaaaactacttaccagctgcaaatgcaaatttttaaactatgtagaaatgatatatgaatattataaaataatgaattgttaaaaaatttatgagctagatatataaaattttgaaattgtttgttgtgacaattaatgagcattgctttggttacaatcaaatagaaatctctattgataatttggttcatcaattacaacaatgacctcataagtaacattccaataaaagaatactaagaaaaagtttcatgccttatatgatttcagcatttatttcttgctcttctaacaacacttaccctcctatgcaataaccatagaatatgtgccatatatgccatcatcatgtttgttttagcattgatattcagaaaccatgacatgcctatttatgacagcataaggaataggaagatgcatttaagatgaaggaagagcaaactttaatcgtcttataagatatataacgaataaattagtacatatattattttttatttatttgtcgaggtaaatatatacatcacattttctattaagaagctatgcagaatagtaatattttattttgaaattatttaaggttctttagaaccttcatctaataattaaattaagacctgcactctttgattgtcacattattattgctttattatagtacgactgcttaactggctacaaacaaaatctttctctaggttcaatagtttcactatttaactaccaagaaattagctttctttaaaaaaaaaattgggtgaaaaaattagcttgtctcccttatgtatctataattttgcatatcatccttaaaatagctaaaatcttttatgctcgtgggatgtgaacatgtagagaataatttatgagtctgaatatacaaaaaataattatttgagttagtgccaataagattcactattactttttcctgtactacaaaacctagggatcaacaatgattgcacccattcatttttttttatttttatatttttaagtaattattatcattttttgtggtcaattaattgattcaaaatcatgctctctccttatttttctataaactaagaatatctccatgccgatagaccattccttaaatatgaattagaaaaatctttataccgccgtagaaaagatatgcttccaattaagaaactcttatcatgaatgggcataatgaaattcaaaattttatccaaattaatgctgtaggatttgtaattgatatcaacatatttagtttatcttcatatcgtatcaacatagacaaaatgctaataaatgtagttatgattggtggatagaatgttgattgtatgtatttgatgtgtataatattgaaattcatattttagataaattactatattccaaaaagatgcaaaaaatatctacgtacatacacaaacaaatatatatatatatatatatatatatatatatgtgtgtgtacatactattcatatatacatacatgcatgcatacatacatatacatatacatatatgtacatacatacatacatacgtatgtgtgtatgtatgtaagtggtatttttttttctccttttattcatcaaacctctctctttatacccgttttcatgtcaataaatatacaaatatttttaaaaaaattattctttatttttgttattctttagtttctctctctctcttcttttttatttttttgcatttttcaaacttcaacaaactgttcctcaaatctgaacttttgactatagccttatattagtacaaagaaaaaaaatataggcagttaatatataggtacgatcacaataatccaaataaagtcgattctgatcggaccaaggctctgaccatacaatactatattaagatggctttttctaatcacaaatattggtatatctcatgaaaaagattaaaaagaaaataaaaatttggtagatgattggaattgtatggatgccagggcgctggcaatacaacttgtttgataatttttaaaccacctatccatctatgatgttttaatgccggcttctacaacctccaccaatggtagttcttaaagcttggaagtttcaatgatcctcctcaagggctaatcaaggtgggaaacgtacacacgcttcattccacctcatcactcatatattaatcatggacttgctcgattgcaagttcattcattatgcttaacttgaaattatacaattttaagtagtcgcacccatgttttcacccttttttatggctctacccacgtattttccggatcctgcgatgcgaaagtatattccctcgcatgagtccacggctcaccatgttaactccatctccgggtttccagaccgcaccagaataaccggaaccgaaagttccacctagcgtccgcatacaacttgtatgcgctctctccagagtccgtttgcttttcccacgccgtgccgcttagacggtagatgtggcatcccgcataacaatttatacgaaaccacctggctgcaatcattactcgccttccccgacaattataagattcccgagttggaaaggggaaaggagagagagagacgagccatggcgacttccaccgtcccgaggctcctctccctcctcctcctcctgctctcggccctttccctttccgtggggtcgtcctccatggagacggtggggcagagggagtgcgattacttcatgctgtgcctccaatggcctggcaccatctgcaagagtacccaccattgctgctcctccaatggctgctgccggtactcctttctgtctccgatcccctcccttttcttctggcgttcttttgattctcttggtgctttttgttggatctaattcggtccgatttggaattctatctggaattctaatgaatccaagaattgaggttctttggtttaagcaggattaggtttagttttgtttgatgtggttcagtaggaaatttcttttgtattggaataaattgaatcttggacggtcgatgtggttgcttcgatcctttgtcgagatcatttgatttgctataatggggtttaaattgttaatcatgcgatttctgaaatgtcgtaatccgggttctttgctcccgattgtctgatttttgaaggatttatatgcagtttgggtgcttaattcgttcttgacatgaagctttatgatggcctttttcttcattttttttttaaaaaaaaagatattgcaatggatactcattcttgtttttattttcttgtaatttcttgatatttgtagattacttgtttttcttatatgttctatttcgtgtaatttggaggaaggaggggaagacaggaggtgacaaccatggaggtttttaagaaaaaaatggaattaaaaaaaaaaaattgcaacaacaatagaattatgcttcgggtttgtttggttggggtatgtcagattacgaggtaatctgatgatttctgaaaattatttatccggaaaaattattgtggaaaataaaatttaccacatttggatggtggaatactagctctgaaaaatggcattggaaaaagattgtgttttattggaggtaatcttatatcgaaatattgtcaaattttcaataatacctgtaaatggataattcaaggaatagcatttttctcaatccatttgtgggacatgtatggcccatttacattcaatattggctattttgaatattgaaatatatttacatgagctatatatatagttacatatacactgtttaatttaatttttttataaattaattatacatatattagagaatatattgtattataaataaattttagtatgctttattataaataaatttcagtatgctttgtaatataaataaatatattaattatcaataaatcctatgttagaattattgataattaataattatttgttaattatttactaataattaatatttatgtataaatatattaatatgttaaatatattattatttatataattattaatcaatatttaatgtatttataatattaatataatcaatattaattaaatcatctaattaatataatgttaatataatataagggtatttctatcagggaatgatattttcagatgacctccactcgatgattcagcgagagaaaacaaataccacccttagggtggtatttgttttaccttctctagcaagataatagatatgggatccatgatttattttactctctctctctcatctacctttcataccaaacatggtaattcaatatgggatttattttcccataatagattacccccaaccaaaggtaccccaagtagaggaataattagcgaataaggattcataaagctattgttttatagttggcacaaggctcgatgtttatttatgatcatggttccttttcttctcgttctatgttatgccttaaccctgacccatgttggagtcaaacatcggactttatgaactgaattattttttttttaaatttccccttttccactaattgaataagtttttcccttttcccccacttctcctacctgaatgacttgtttgatagttgattggttcactgttatggcctttcttttttcttttatttaattatttggtttgttattgtttgcaataaattaagtttgaattgctttatatggttttcttaagattgtgttaagaaggccaatctatagttctcttcttactctgtggtttatatgcagtcttgtggttggtttattctttatctggaatttttaccctgtttttttaatgcttattctgttggagtagatattgttatttttgtatgtgtggctcttccctaattttgtttcattagattacccttgatcagcggcttacattcattataggtaaatgaggaattgttgtcacgactattttctaattaattttgtatttacctttttgccctcgacttattattgtttgttcttcttgtttaaacctccttttatgttctttctcaacttattattgtttgttcttcttgtttaaacctccttttatgttctttctttttatttcatcaattgtaaggatgcatcttgtttatggataaattacttatcctgcagtgctgcgattttgtaccttttacttcttgcaaattcattgttgttgtgattttaaatattacttgtgttatgaaggcgatatgcccggatcttatcttcttagtgcttttgcagatcacaacctctgacacactttacaattcgtaagtgctatgctcttgagtggtattttaatttttttttgcgcagttgagaaatttgtgttatgtgaccatgctacgtttgtgatatcattatatgttgtgaatcttcattcttgtcattatatgttgtgacaaatgaaatccatgttattcatgtataatttatcggaaatcatatcacaaagtttctcccaactgctgattatttcaagagaattagtgggataaagttcaagagtttgaggagtggcagcaacatgctgatttatagcatttatcaggggggaaaattcatgtgtgatctatcgcattgtacctccatccgagcgatatgaacaagaactgctagtctgttagtctcttccttgtcaaagacatattggggttgcatatggatttctgaaaacatgctttattttttgttaaccatgcaattcttcagatcacttatgaatgttcatttcaagtttcaaaataatatttgtacttatagctagcaaaaagatttgaatatgaatgtaaatatccgctcttgaatatctaccaggaatcattctatgaattgaattctttaactgaattgaacattgctggattctcctttcatgcttgttagagaactcctaacctgattaggagttgttccaatttactggaccgccatatttccctcatcttggaccaggtccccatttgtttacaaggcaggtttcctagtcaaagtcagaatcattggagttgttgaataaacagagaaggagaaaacctgcctctttatctcttatttctttacccgttttcctttatttcttttctttcatctggcttgatgttattgtcttttgcactacaagacaagtaaacaacaaaaaatgtagcctatgtgtggtgttcatcatattgacatgttcaatctcaacaagcttgatattttttttttaaagttcttatgaattgcttgaatgtgttccacaaaattattaaaacaaactcatctgccattggatttaattgagaaatgaatgggaacattttgcttctctagccagaaaaatacagtctgctgctgagtaggtacaaagaaattagacttgtaacaaggagctgagggcaggtgtcgtcggaagtatataacttggaacctagtaggatgaggatgacacttcaagttcacctaaattgaaaaagaaatcatattgttctaatctctaaattatggagatagcatcttagaaatatgagacaatttgaaccatagtctgctgtaccgccccaaaccatccggtacaaagcgcactgtaccatatcgatatgccgtattgcttcgtaccgacactactgtaccatattgaaccatgtaccgacactacgacagaattttatgagtatagggtctgggaccgagatggcgaaccttgatttgaaccatttatctaatataatcaatccttttttcaaaaaaaaaaacagatgtacaataggaaaaaaggggaaaaaccttctttaatatcccacactcctattccatcctgtgctcagacgctgatattatttttttgatcataaaaactaaatcagaagttccatttagatttttgtggggcttgaaatgggtggtctcatgccttggatggtatgtgcatctaaaataggcaacagaattaggagacatgaacttaccaattttcttggctctgcatagaaaaagttctctctttcttaatgtcctgatggaacccaaagatgttcagagaagtgaaccccatctaaacttatgttctaacacagatgatcattacattgttacttttgattaataaagttttagtgtcttgatactctggacttaatactccattgtctaccttttataacagatggtctctggccaaattacgatgatggaagctggccagcgtgctgcagtcactctgattttgatataaaaaaggtgcagaaatcactgtttcacagcaatatatgtacaatcttaatatcttttcccttgttgacaaattaaatcaaataagtttctttctgactttttggtgtttgagtatatctgcatgcaggtttcatctttagtaccagaacttgagaagtattggccatccttgtactgcagctctccctctctttgctttggtggaaaaggactattttgggcacatgaggtagcaacaaatttccaaattacttccaaatatattcactacaatacatataacttacaaacttctgttgttttggtgcatgtgttgattggtttggacctggacagtggggtaacatctcttcttaacttatacggtggagtagaatactatcttttaaaataaattttgcattattttgtttagaagaaatcagtaaagttcctggaatattttgtcatttataagttcatgaaaatataactaaattcagagggttttgatatcctttcctatttcttacaaggtttcaaatgctggcctcacataccatgctgagacagtgctgacacctagcatgggttagcatggcaccaattcattcattaatcaaaaagagcactgtattctttttaattaagttttcagttcagcatggtgccacaatatgtccagtgtggctagcatatcctccagcactggcactaaaatctttgatttcttatccaccaaaaaatataaaattgtaatcacaatatataattaactactcattagaaaaagaaaagaaaggaaacgatgtgtagaaaatgaaagaaatctaccttcgatggtacatttgaaacagtggtttatccatccaggtttcaaatactggtcatacacataaaagagaagccatgatgcagaattccttttcaggcatctccaatctgtgatttactgctgttggccattgcctgtcctttaaaaaataatagttatgttttaaatctgtagtaaggattggtttaaaggaaaaagaaattgaaacctacagttcattttcaaaaattataggtgtccagttttgattaccagaacaaggaatgttcggtccatatatatggacagaaaagcaccagaaagaaaaaaggaaagaaaaaaaaccaggtacatgcatggaacatgttttgggtttccattggacttatgcccttagatctagtaaatatttcttttccatttaatacttaaaagctaaaccagtatcgtggggatcaattgttagttgttatagttgcttttttctatgatatacacgcattcattcttcaccgtgtttgttgcttgcagaaaagcatgggacatgttctttcccagtaatacaggatgaatatgactacttctccacggtccttgatctgtactccaaatacaatgttacggttagtgttggaagcttttgcccattatacctactttaatagatctcctaatgtttccttttcatttctactactgccttgctcattgtaagtctatgatcatgttagtcaccttttcctcaatttcagatttttctacactaaaaaatgacgaaactcaacttcctgcctaacaagtaaatatacgggtcatattctgtcatctgatagtggaaagcaattgcattcaaattttttcaagaaattaattatgcggtgcctgttatgttttctaatatttatgaaacctttcctattttggccagatcttttcaagatagcttgagttaggaaatctcaatttttatgtccaaggaaagttggaatgttgaatgttggaaaccccatcttgtactgaacaagcagtattccatgcaagaaaatattgaatacaagaagatttgaaatgcatttctcactacaagtcaacaaatcatagcattcaccaggtttcaatatttctgcagtgctctttgtgcattacaaatcacaggaaatggtagaacaagcagtttgttatagtaataataggcatattatggaaccacaatgctagaagcagatcttactgaccaaataaggtgcattatagaaccaagtggaagcaaagcttataattaataattaactacactatcctttaatgcatccattttagagtattaagaaagtcactctgcatggtatctgtaaacttgagttatcaagcttccattttgcttaacagtttgctgtgcttgcagagaattttgagcagtgcaggtatcttagctagtaatggtgacagatatccattgggcgatgttatttccaccattaagaatgcctttggggcatcacccatagtggtttgcagacatggttctgtggaggaacttaggttgtgcttctccaaggattttaaggtcagccatgactttccacccacaaattcgttccagttgcctcactatgcaggaatatcttgttcatacaactcacccatgatacacacatttatctgtctacagacagatgtttgggttattcacttattatttgtgattctagaatttagcttgctagtcaaggccggctgtttgctatattgttatttttgccaaaaaatctcacatagcatattcagaaatttgcatggacagaaactacatccaaattcctctaaagttgaaggtaatcgggaaagctgtaaatttagagactcaggtcatgttctaattgcaacttgcaaggcactatcacaagtcacaactgattagtatttttagcatacatcataaaatgaaaatgcaaatgttacaataaggatacataccggccatttttttgcttatagacagaccagatcaaacaactttagtacacggataagcagttgttcctagttgatatgggcaggtacctactaaaggtattactattttagtaatgtaattcaaatgccctactcttcaatttttgtccatctaggtcctgtcaccatcatcatgaccactatcctctcctcaccgtgtctctatctatcctccatttctctctggtgtcagcttcagctaccatcgctacctttgtagttgctctgcccccttaatgacaacccagctttgttcttgtcattcttctgttgggctgtggctggcagtaggatctttgtctgctccatttgtggtcactgttccctcttcttcacatctctctatcttccatctttcttagctgccacttgactccaccccactattgcagttggtctgcttttaatctcccaactgatctcctttgcatctttggccttattgttccctggcactgttttctgttaagactctgacctgcggccgcttcttccaccatttgccaatggtccatctttcgcccccacacatctttgggaatgtttggcattgcttaaaaaagtgcctgtgcggcttttaaagctaaaaagcacttctgcaacaaaaaataagtactggccaacattatatcgaaagtgcttctacaagaagaaaaagtcaacaaaacgcttttaggagtagctggaaaacttatcttctgacttctctttttataaagcagaagcaacaccaaattcgtctattagtaatgggagaagaagatccttactatttgaacagtactgagtttatttttacttattaaagtgaattttaattgagagacaaacatttgataacccatgtatgttcaaaaataccttttctgagcccttagtttgcttccaatttccatatgcaatttgcttttcttagcctggcaactgaggttcccacctttttgtggaaggtgattgtctgagacatttgttttttgtctttttttttgggggggggtacaaaatcattcttttctctttaacaaatttattgagatgccttattgggtggtttaagtcagatttgtgatcttcggacataaaatttactttagaggctaccttcagtattttgatattagcttttgaaatcagcaaggattctagcaaattaggtgtttgggattgcattatccaaatcatatatagcatagattttgctcaatatgaatgtatgatcctgcatgtatacaaggccttaattgcactgtgtctgcttttttttcagcctcgtgattgcacgatgggatctgacatcatagatgatgcatcatacttgagaagctcttgtcctagatatgtcagtttacctacatatgcaccgctcggtgagtttttcgttttatacatctttaaatcagtttagtcacccctcccaatcatgcttaccgtggatggtcaggttactttcttgtcaatatagcgctagatttacagcttgtactcactctgtgctattttttttttggcaatgtcagtgcttggtgatgtcagtggagcaacctcttggtcaactgatcattaagacgacgaggcctcttagggataatcatgttgcaagatccttgtacgaaattgaagccgagtaaaatatcgtgatagcagtgaaacattgtcaacctaagtagttagccatcctaaaattccatacggctggttatcttcatcgtgtaaattgcaaacatttcattcaaatatgcgaatgtaatatatatatatccatgcatggtcctgatactatgaggttattttcctttccagttatagcggttttagaggttggttgtgataactgatcatccatccgtaccaactggcttgttaactaagatttttatgaataatttgtcagttgtatcgttttaaaatccttattagttgggaattggtaaaatgcaaaacgttcagcctttgaagctcagggaaaagttctctacgatgacttgaagctgaggtgaaggaattgaaactctgcagcgttgcagagtgcaagatgtgcttatccacatgttacccggcgacagaacggaagttacaagaatggggaagttagctgatttcccaatccctagaatttagcacggtagaaaccgcccgcatttcaaagattttccgtatctgtgatatgggggttggatgctgccaaatacagtaccacctcttttcattttaggattgggcaaataatcgagacttaaaaaaatttatataatctaatctaataaatatcgaccagcatgaatagaatgaaattaaattaaaatttataaaaaattaattatttataatcaaatttgatttttacattattaatttatataaaatcgaatcaaatcgatataatatttcataaatttatttttatttttaaaatattattatttaaatttcaatacttcatttttgacaaacacctcattatccatttaaattcataaaaatattaatattaaattattaataaaactatattaattttaaataatttttaaataaaaaatattaaattaataaaaaataaataaatttaaataaattaatattaaatcgacattaaaactcaaactaacacaataactaacccaacctatccaaatccgctgtaaatcgtttattttaattttaaataatttatatataataaataattaataacagactaaatttattttattcgattagataaaaaatttttcgacctgatcaaatcaaactcatgctcagccctactccatatccaacttttctctccgaagatacacaccgaccgatggaccatgattaggctgtccgaacaggccaaacagcagctagctgcagcattcagttccttttatatacaattttagcagtaattatggacacgattagacatgtacaagcataaaacgagcaatttagctgtgtaatgtcaactgtgttctctctccaagccccttcccgtacaatctgcgcgaacaaacagaattgtttgaagaatttttttcttcccataattcttgcaaatgcacacgcttgctagaaatacacgaacattgctttcaatctggaagtatgccaatctcagttatttataatacggtcaaataattgtttaatcttatcgatggacttgctgatgagaccgcgtctgtgaatgtcatgcaatctaaatccatacgtttgactgcctctttatatgcatacctcctgtttgacaagtttctcgactacctgatgacatgaaatctttatttcgatgcatggatgcaggatcagttgatgacagaatcttgacatgtttctcctgcacgataactttgagtgatcgaaagctggttcctttctattaatggaggtctcatgaaccatgatagctgtatatccctgtgaacaaattgaacatgggaaaatgacaattatattattctgtggtgcttatcacaaagacatggagaaatgaataaatatagaaacacatcacatatgaattcgtgcatgtgtgcatgcgtgtttcatcctgtgaaacaactgacttgtgccaagcctcctgcttttataggatgaatggattttgcccaacttctgtgcaatcttgataagcaagaaatacctgaatcacgaacaaatcaaaatggaggagcaacttctgcaggatcaatccatgatggtctctttgcgttatagtagaaatgtgcaatcatttgcaccaattcatctgccgttctgagttctgcatgcccaaaagccaaacaatggataagggtcgcagcattttttcagctaagatggtttccaataacatgttcacacctttctccctgtacaaaatcctgtttccctttaggaataatagttgtgggcattctttcactttaagagcataagctaagtctgtctcgatattaatatcaatcttgactgtctgcagcacataacccaagacatcatgatttgtcagaattaaacatgataatgtcgggaaagcgtacagtcaactcaaatttcagaaataggaggattgtgtacgcatcccagaaactccgacgaaaataaagaacactcaaggaatcataggattaacaattcagaaacattaaaggaaaaagtggcatactctaggaggcagtcgatctttagcattccaatataccttagctgccttctccagctccttcaaaagcctccagttatcagctgccctgtgatcgagcagaaaaattcacaagaaagtggaattcatttagctagttctgtaagtaattaaatagcaaacttaaggcaaatatcctcaatgttgtttcccatgtttaacattaatcacttaaaatttcacatggatcgcaacttggaatttgaaaaagtatagaatgtggaggttaatttacctataaggtcagctagtctggttatttatttgtagtttttaaatgacctatttctggaagcatcttttcttttagttgctctaacacacatccttggtatgtaatgttgtacaacttgaaataattgcaatattgttcaacttggaactccattcttatgtttcataaagttatacaagattgccaagctattagatttcagaagttggtaaatatcaattgccacaaacgatcaaaacatacagtgcttcatttccaattaaactcattttactataacacaggagaacttggcaatctgaaggtatgaaatggatctgaccatctttgaggtttgcttcaccctgtttgtggtttccacattaattcttgggcggcatccattgtacattcatttttttcttttgcgcacaatcccctgctagaattctgcgtaatatttgataagttcttataagttcgactttttgcatgcataagctaatagttgcattaacccaaaaaaaaaaaaaccactaaaaagaaatttatgattcaaacaatacccacagttcataaagatcctccatttagcaagggcttagatcttcatcaaacacgcccaatacacatcagtttattctgtcccaactgacccagacacctcaacaacttgatgcagatacaatcaatgaccttatattctctcataacaatttcactgccatctcaacagattgaaataatcacacaccataaaggtaggcttgcacctcatccaccctctttccatttatatcttgtcttatttatattctgatcataattttgtaacatgtcacctaccttcatcgtcgcctaatcataatttttctttcttacacatcataacatttatctaatagttcgcaatactttcttatccatcccaaatataattgtattccaatgatataacaggccattagtgaagtgaattaaaactcacatgaagaagaaatgtacggatccaataccttctgtagcgctcaaagactagaaccacgagagggctgggatggaaggcaaaggtctcccactccaagcagttgatctctttcacccacccctcatccatctctccctcccagtcgatctccaccccatcgacgaccacattcttgattggatgcttctcaaagtattccgatgccctgatcccccacccgatatccgcatccaaaggccagtctggatcctcctcttccaccacctccttccccccaccctccgagctctcctcctcctcctcctcttccaaagtcctctgctttaagacctcctctttcccctccaaaaccccggcgttctgctcccggatagaggcgaaggtcaggtcgagccggtcccgaacgaagtcctccaccgccgccgtctcactccgccggccgcgccgcggcttccgtgggatcgtggacgggaaggcgtcgccggagtccgcggtggcggttcctcccgccggggacttgggcttcggacgccgaccttttggcttcgtcgggttatggctaggtctggggtcgggaccggagttcgagttagggctcgggtcgggagtggctgacgcttttaaggggacgaacggttttgggcggcggcgagggtttctccgatagagggaggaggtaaaggaggaagagttagggcatcgggagtgaaagaagagtgggaagaagggggagttggcggcgaagaaatgggagaagggtttggggaagaatgtatggatttggagcgatgacattttcgccctcccggtcccgtaggaagaggacgacggtgcactcagtaagtgtggataaggtatttaaataaaactttgcgtatgtaccgctaaaaaaaaaaaaattaatatatatatatatatatatatatatatatatatatatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaagaaaatcttcagcacttttatcgagtaattacatggaatgagacattcgcagctcaattgcacaaatttcgttccaactaacacatggaggtagagtttatgttacacaactctcatccctacaccattccctcccatcaaacaagataaagttttttttaataaaaattaaaataaaagttcttttgccacccatgtatcatgcaatctgatgccactttgagatgtaccctctacaccagcattgctacttttttttcctcaatttgagcagcaggcagctctagtagcgaaggttccttggcttggctgatagccacgttagccatacaaagttccaaatatttgcatctgttgaacattctatcagtcttacatactaacatattgtaagaagtggtataaacacagcagctaccgcactaatataaaagatagaagacgaattataattggctgaaaacacgattctagttttccctgctgcttcatagccagaaggatattcctggcagtagaaaagagaccatatgtgcaactcaagtcattatgaattctagaaaatatttgctaaaattttatttaatcactaaagcagcaggacatataaattaaaatgtaaataataacaatccgtccagtaattcaattacatccctttaaacacaaagatcagacttgagatgcactatatataggtccggccataaaaaataaccaaatttcccacgagtcttgtgaaacgctatgctctcttcacactaaagcagcctctgaagcataagagaggtgcaacaaataactcatgcaaaagcgaggagttttgagtcctccaacagaacgagcgtgagtagcttggcaatcttgttcaacttgaaatctttcctgaaataacagcttccaactggagttttcccccatcccagaacatgaatcaaacacaactatgttagaaaatgaataaagagctatttgtttagtatgagctctgagtcacacaggttatttgcattataaaaacacacactagcttatacagaattagataagtccactggtctaacaaactaaccatgggattcagaggtgcaataccaggaacatgagtggcacaataacactaggtacaaccaggttatatgttaaagcctaaaggccctgaactgctaagcaggcacaagcacaggagactgcattgatggcgttactaggtggtgcaatcaggagtattgctaattgacttagctcagaaacctttaaatcccctggtaaagttgctgggtaacaagtcatttgatttaacatggatataatcggcctagcaaacagccaaacaccatctccatggagatacaacagagatggactgttttgatgtatatttcccgaggcatgaaaaaacctgttgccaggaaaactgtcttgccattgcatccttcaaatatttcacagtgattgcaccaaagttaaaaactttgaaatggcaagcaacaagcatacacaaattagctccaccggtcagcgagattaaatattcatgctggccataaatgaaaaaacatgttacgttaaggtaccagttgaagggacatgctccaagaaaatagtgtacaccaagtgcgtatttgtgattattttacccgatattcgaaccaagcacctccaaatacctctgaaacttgccatattccctccacctctcaccatcttgtcattaaccatattccctccgacaaaactgccacatttataaggcccataaactgccatccatgggactgctctggcaactcttcacatgtggtgcctttctcggtcttgatctcctcagtgactttgcaccattctccaaccacttttcccatccttcaacaccactcactccacttgcaatgattcaggcacccaatatccaacagctccaacccataagcaagctccgacagccaataagctcttcctccacaccctgtatcttaaccatctctacacaaactaacaagtatcaggtaagtttctctatgttaagttatttataacaaaaagcccttctttgcctgtatatattgtcaaaataatggagttgatttttgagagaggtgggaccactgcccctaaggtcgatatgaacataactatgacactaaaagtaacgagtatcatataatcatttgataatatgttgattttatcttcagaggtggccattgaaggactttgtgaacatattcagtaataatcatgtatatcacctctacatcaatttccctcattttgagtaccttattggtatgatatgcttcttaattttgcacgaaggttacatccttggtctaactacatggtttttgtgctgatgatgctttttatgactaaacattgattatgctctaatgagtaaatacaaatgtcatactaacttcaattgaagatgatatattgtttgaaactcagaagcatatttttctctgatgctcatgaattatgaaaatgataaaggattcgacatccaaaaaatcattataatatagaaaagtagagtgttgtttcgaggtttcaccaatgaattctgtcaacagaaaagattgttcttacaagattaacaaaaaaataaataggtgaagtttgacaaattggataaaaaatccggttgctagcagacctgcagaaaggcataaccatgaccttgtatatggaaaaaaaaaatgtatgtcgtgcttacacatgaaaatgcaatgtactcatattgctaaaaaggaagggataaccccaaaagctgcccttaacctgatggctcgaaaagctggtagccatgccaatctctaatttaacttttgtgatcagaaaaattatttagagtaacatgtcattattcatgaagttgagattcagagcatttatgcacaaccttgcagaaaggcatgatgctaactgaggtttccataatgctgcagaaagacaggtgcaaagagataggcggatcacaatgataagttttatttgacacaactataatttttggctcctaattcttttttaacaaaccagtcgcattcaagtgattgtctgtacacaagatgagaaagcaaccgaaaattaactcgacaaacaaatatgcagcaacatgtaatgctatagccattgtgtgtcaaggaactagtccgtttttctttgtgccacttatatgaagggaaattttttttaaaaaaaagtcacattactgtaggtgcaaaatcattggagccaattctgtgaatatgagaatgagaaagaattcatattggcatggtaaaagatagtggaagatcattttatctaatgggtaatgtttagcagcctaaggataattgcttgtgatattcacagtgataaaaggtgcaaaaaaaatcttagattggcactggttttgtaagctatgttgatagacactacatgtccaaaatgcgattggaaagggaaaggtattttgttttttgttagaaaaagcttaacataatttaacaaaaaacttaccataaatttatgttctaccatgtaaaagctggtaaaacataagatggatgggcatcatatttacaagccagagaccgaactgtatcagtgctagcaacttccccaaggccactaagtccaagttcagtagcatgaatcccaccagtaacaaatgctgatgcaattccagctgcatttgcaccctttatgtcatggtggagagaatctcccacagtgatacagtcacaagcatttacaccagccatggccatagctgatgtatagatcacctgacaaaaatttgatatgttacactcctgaaccacaaataaattaaaatatgttcacctaaaaagagagaaggaaaaagtatttcttctgctttatacattttaaaaaaaaaaatacagagatgaacaactaacatggcaactccaaaccaaacattataaacaatgctaatagatgaaaagtctaagttgactggtgaaatataatcaaaacattatacacgtgaatgtcaacatataccgatccaattaaaaaaatcaaaactagaaaagagacctagttgactactagcctgctcaactgcagatacccagatgtcaacccacacaaagcatgaactcacattttcttcatagtagagttaatggtgcaaacaaaatgaccaccattcaaacaaaagatctatattgttgatcattatctacaattaaaactgttcaaatccaaaattatacgttttgacggtctgcttatgcatcaagtgaatgctaaatggacaatattgatagcataatgtcatgctttgctatgatccactggtagaatatgggataatccaacaatatgatcaatcgaccgtctaaatttgaagtacaactagacacaatgattcttaggaaattaaatatattgttcatttttgcagtattagcatggtttcaattttcaagtgagacgatataaaggcttattcacaaatcttccattcttcatataaaatgcattaagactgtcataggcagggtcaaatttggaattgtcacatgatagttttggaatgttttctgtgaaaatgaagcgtcaagttgtataccaaactcatgattgatctaaataaaacatcaacaaaatacatgaaaccaaaccatttcttaaaattcattcactaaaaaggaaggttggaaaagagttagtagtaatgaactaattttgaaaatcagtttgtaaaactaaagcacagaacggcaccaggaacccatagaagagctaacgagggcagtcctaaccaagtgaccaggggcttgggcaccgaccatacgaacctttgaatctgattgactatctccaatctgcttcaaaaatcgtatgatttggagatccctacctatacattgcctgacaaaaaatggataatttaaaaaacaagaaagaacaaatattttttgatcattgaatgcataggctagggatctcaaaatcaaatgatgtattcatagcaagcatattagagatagtagatcacatacaatagctcaaatcgttggtgtcgggcccctcctcatccgcttaggaccaaccttattaggactcatgtgagtgcccacttattagcatttttctggaaacagccttagcagtaaatatctataagaggaggtgtactgggaacatgaaacgcaagaagagtagaaacaacttgctttttagggattcccctattgaaatagcaagaatgaagaagatacaaagatgataaaaaaatgaggagaaaaagaaacagcctgggctgttaagaaatatcgatcttcctcctcttcttatcttgttattcatttttcttttttgctgaatctttttcctccatatattcctccagcaccactattcttcttccaacccactcaaaaagaggacttagaaataggtgggatgcgtagaatatcgggtgccaatctgtaaggacctcaaaccaactactgtctggtaagcagcagggaattgtttatctaatcgtcaaccatccatacaggtattagaccatgattagttaacaaatttcttgcagtttagtcaaaaaagcaacccacatccatatgtggaatccacaaagcgactgtataagaaattgcagggatagcctataagtgactatccatattcgtcaacttctgctatatcctggggaggccccaaattcaggggattgtcaatggcttctgtctagtaatctgactagttcagaactaaaaaacctaattacatgattaatttcggaacctatgaaaattcctatatttctgcacaaaagtttcctgactgaaaaataaagtatgattgaaggagaaattttatcgctgggagatagagagaggtttgaaaagctacaacaaccactaaaacaaaattaacccattaccttatcaggtttacccatccatttgacttcaccaccaagcttttcatacttagctcctagagttcctagaaggaggaaaaaaattaatgtcccactcatcacaagtatttaatttcatctttcaaactgaatgattgtacatgatcgaaaataaggaaaattcattcaggattaaagactaaaagcatgtttccagttcaaactactcaaagcaaaagttgctttctcccctgccccctctagatgacatttactacttaaataattaaagtcactgttttataaacttcaagttctgtcaatcataggtaaatcaagatcaatgagatatatgaccaaccataccaggcataacacgcaaagctcgagcttcaacagtcacataatcgggatttgcgatcaccataggaatttttttcttggcacacagctccaagatttgttcaagagcctcaagattcatagggagcacatcaccagaaggaagaccaagtgcttcagttccatgagccagtatgaattctgcatcatccacattgctcacaacttgcaagcctaagccctgaaaagttacagatattgagatgagttagttgtctactaaaaatgtataattttattagaaaagaataatgaaacaggtaaatcactgtttctgctgttgaaccatccaagtatttaaaaggaacaatcatcaatggtaatttaagcccaacaatttgaatgaaataattacattttttggtttcctgagagaaaggtcaaataaaacatctttattttttggcctcagtttcctgtgcttttttgcacttcctgctcacattatcctcaggtcctagccaacttccttagggctgttagataaatttcaataaaacgacccctttaggttaaggtgacaacatatccatggttcaacaaaaataaaacatttggcagaatatacatagtccaattccggtactttaaaagaaactaaaaggaaatacagaaaaagggaagttcatgataagcttagattcacaaaccacagacgatcataaactcaagctcatctatgagcctaattttgatagaagtaaattgtcaactgcaaatactggaaattgacattgtaaggcccttgagtaaaacatttgcttaagaaaattcatgtagcaattatcccaaatcactcgaaactccaaagattcgagtatgtcatttcaaaattatgcttataactagccactaattcacgcaaatatcagaagggaagactaaagaaaatcaaagatgtgaacatacctcgagagatattgcaccgcgatcactccaagtcatgtgaatgcaagatcttcctagtgctgcaaaccatgaatcatccctcctatttacatcaaatcataagcaacactcaacaccatttcatgtgaatacaagatcttcctaatatttaattcataaaaagctgcttaaatagccactaaatgtttattgcagtgttccgatcagtcttcttaccatttacatgcatattcagattctcaaatgggcacattatctactaaacttctgaataatgacttggtggctgattgaaaatttatggtcatctatgcttgatataataatggaaagtgatatctaatagattattaaacatttccctaactacaatcttttttttgatttttcatgatatcagttcctttcaccaaatgttttctacttgaaaatgaagaaccataaggtttaattgatcccttgggatggaaaaaccatgcgaaaagatgagaagatgtgattctggtattctgatacttttgccgacaagcaaatgtattatgaagaaaagctccatggagcatgatttgtaacgacagataacgaagacactttgaggtctagccttcataagaaaagcaaaaagacaaagcaagagaaaggctaatagcataaagtggctcacaaaggaaaccctaaaaaaaccctaaatgtagcagcccaatgggcaaataactggtaattaggtataatagcaagctgcaaaaaagcaacttgatattccaatcaaatgacatcaaactttgcaaacaaatgatcatagtgagatgtacgattaattgacattgtatagcatgggaaacggtagctaactttcataacaatatctcaacttgctaaagtggatagattagatagggcactagagtgaaacatttcatatgaaaacacaagactcataaaactgaggatcacatcgtagagaaaacaagatgaggccaaccacctagtgcatctgatgaaagaaaaaatggcaacaactgacatccaacaagtttattgggtgtgcgaagcaaggtcaacctgagtacaaatatcaagtatgaagaaccaaagagcaataagtgacaaaaaagggagttagatggcatgggaaaagtgaataattcatgtgcccagcaaataagctgaacaaaaggttataaaggataacactaaggtatgacaaacaatgactgtggctgcatatggagtgcagatacacacacacacacacgaatgcaggcatgcaaaatgctccacatcatctgttaaaagaaacttggagtatcatcaagctacagtgtgtcaggagttgaaagcagacgatagggaaaaagtaaaaaaaaaaaaaaagactactagaaataaaagtggtacatgactcaagaggttagaaaaataattggccaatataatgcatctaatagcagtaaaaacgatgcaaacagaacagcacttcaagtatcaaacccaaggaagttgaaggattggtcattcccaaaatagaccatgatagcaaggagacaactgagaagtacaaggaaaacctcaatccaaataaacaggatctgaagccaaagggaatcttaaggacagataaaagcaagggaaggaaaatatgtaatcaagaaatgggaggataagtcgaaagaccttaaaaaaaataaagctgaatattttgaaagaattgttagagagagaagggggagagacccacctgcactatattatccacgttccagtttttgggaattcactgcaaaagaattgaacccagaacctctagtagcaatgcaaagggatgtcaccactagggcaaagcccaagtcacacccattggcaaagaattagaattcagagaagaacccttaaacaaaaatactggggtagcttgccttaaggctaagtatagagaacaaacatgcactagagcaaacaagtctgactgagggccaagagtatagaagcaattgttatataagaaagaaattaagaaaaccaaatggatttagcaaatataagatatcataaaagaaagcattgaaggtctgaaggttactagagaacaatagcacaaatggttactacctggacgaagtataatgtagagaatcaaacagtacctagtagtcaaaaatcaccatgaccacccccccactcaaaaaaaaacaaaaaaacaaaaaaaaacccaacaccaaaaaataaaatgaaatgaaataaaatataaactttatgatgttaaggacccaaaaattgaagattagaattgagatgagatgaagcatggaaacccaaactgaattcattttactttgttcagatggctggtgataagtaaagatgagaataatctgaaattatacttcaggtattccaaccaggtccatgaaacttttgaaactaccaataatttttgtcaatttaagtgatttttttccaataattttgtttagattattggaagcagtattcttatgcatacaattacttcatgtacatctactagcatacttatcttacaattttaagaaatttaagagtatgtagtaaagttaggatctgcatagttcttaaactagagtcaataatatgaagcatatcttgaacatattctaattaagaaaagactgacctttcaaggcttctatgcgttaattctccactagtgattgccccgataaaaatagaaggatcaaagccaaggctctttagcttatttatagttgtagatgctcgcctagaagaattactaatgattaccatcttcgctccatgatatgctagcttttctactattataacagaatgactgattaataagtacaacagtatcaggtggtgaataaacaatcactgccaaattttttaaaaaaattgaaacaaacaaaataaacatacatgttgaaatggcaccaggatatggttttttcccatcatgaaggactccaaactgatccaagaaccatgcctgtgatgtagagcgataaaacagtgagaaaagagcaagaatcaaaaaataacaatttcgtagctgagccaaaacaacatagatatttatcaatccaaaatctttgctagatcttgtagcagttttgataaggggtgaaatatcaaatgttgatgaatctgcaataccatacagggaaatctttggatgatgaagcaaattagatgcgagaatctaagaatcaagtagtccctaatcagcataaaaacttcgaaccataatttgaggataagggagtagaaaggggattgcaagatcacaagaaattgaattttttccttaaaagaaaataggacacgaggctcctgccactacgggatctaaggagggttagatgtccgtaggcttatccccacgtgcagagaagctgttttcatattttaaacccatggcacccaggtcacaatggagcaatcttaccattgtgcgaaggcacgatctcaaaacatgatagtttatctgttgtgaattattttagattctgaaaattagaaatggtggcttatctattgttggatacatgcaagaaaaaggattcttgccaattgatgcataacgaaacaaggtgccttcagagattttactaacagcaaagaatgtttagggaaaaacaaaaactcctaaaattagtaagaagaaaaggagacacaggttgataaatattgaaaatgataaacagatgaatgaaatcattgtacagacaagaagaaaaaataactgattctgctagtccaggtttaactgctttgcaaaatcttggtatattcccaagtgagtatggacagccatcttagagaggtctacacagttgtacactctacataactctctctatctctctctagcaccaaaccaggctaaatgagtcgcttattttagaaatgcttctcttctatcctgtatgattggaaaagatctcctcaattcagaaaacaaatgagccaacagtccaagagcaatggacgactagtggaggcactagttcagtcaaaaaccggaaatccctatgttttacttacttctttacatcataaatgacttctattaataggtttaggtggaataagaggaacaagaacaagtcaatgactagcaggaaaatgtgttcattaatattatcactgacttcatcagctataaaattctagctaaattatcaacaaataaagcctgcatgtttttctgctctgttaactccatgttaactccacgatgatggatggctcagctttcagttgttaatgagccagtacattaaattttaacagcataaaatagttttggagtgacgcattggtcggtaccatttgtagcgtattacacgaacatgcaaacattttcgtgacatttttctataaacatgtccaaacataattgtttgatcggtcctgcctcattcttgatttgctcaaagaaagaaaaaggaaaaagagacacgaaagcatgcattacacgatgctatccagctaatatcacagacacaaagaaagaaagaaagaaaatttggaatcccggaaccttaaaacgaccactttctgcaagggttcggatcccatccaagcactggaaggtccgcgacatctcagcactgctgcctccttggcacgaagaaatcgagcatctgagcgccatattcttcccctcgaaggcgcggcggaaatcacctgaagatcgaccgaaaaagtgagcagaaacaaaactttgaagcgaaggggcccttggggttttaaatcggtagggaaagctacaagttttcgaagtggatcgaagaggagaggaagttaccgtggggttggattcgccgtgttcttggattgagaggaggggggttcagcgaagaggggactgatctcatcatcgccgaaggattgaggccgccaagataaagagaaagggaaaagaagagcccgcaagcccggcaagaatggtctggttggacctatttccaatttgaacctgagcccaaattgactatattaacgcagggaaaagtgatccctgttcccatttcatatatatatatatatatacatatagtgggcttaaggtgcaatttgagggtttaactgtcttcttttcttaccaaaaaaaaaaccaagaaagtgaacaaaaacaaaatgatataaaactagacttttttttttcttcttttgattactcccattatatatatttttctttcttttgactactcctattatgctctatgatttattctttatggccgattggttggtccaaaaatattactatatattcatgaaaatatatggaacaaaaaaataaaaaaataaaaaatcaataatttattccaacagacctgatcaatgtttgtagaatctcgaataaaatactcgtcttctttcattaatcttcatgcataaaatatattattttttttcttttcttatctatgattaaagtgttagtgatatatttttgtattgatgttttgaatccggtcaatttataaaatgagaaccatgcctaaaaaattcaaatgccacgtaggctttagaatttattcttttcttgtatttgttttgtccgtagagtcacctcactaatcactttttggtggaacaacaaccccaactgatttaaagataatgtaaagataataagttaatcctaaacatatcaatttccttcttctatattttatgggttgaattagttttaaaatttgataggttaaatcattcgataatatttaattctttctatttgaagtattctttcttatataaattaaataatttacgattctatttattatactactatatggtacattttattttataatataggtttactgtaaaacaaatttttttctaatgaaatctaatcaattagattttcttactgttactcaatattattgtcataacaaaacaaacaaatattttaatccgttccaaagccgcgatctaggatgataaattggtaattcccagtttctttctcacttaaatcttttttagaactttcttcaccaaaattgatgaataatttcttgtttttgaatgggctaatttgttaccaataagtaacccattagaaagcaaaaatgttacaggagcttcctgatacatcctaaggatacagagaatatctgaaaaattcctttgagctaacttggacattgaagcttagcttgaaaattatcatgatgattcaaaattttgtgagttggctgggcttgattgaagccattggatcgtagcctgacaaaatccacaccaatggcaacacaattttggcaccatatcatattatttaatgattcagaattggcaacatcagctagctgattggtgaagcatatcagctatcataacagcaatatgtgtgtatgtccggatatatgtgtgtgtatatacgtacatatgtacgagtatgtatgcatttgaaacagcatattgctttcatattcacgaaatgtcaatcacatcaacaagaatcagctgaggtataaggtagaaagagtagaaggtttcaacagggttgatgatcctccaataccagaaactgtgagaaaaagaatcctaacgtcccaagtatctccagatttcctggccgttcgctgccactttctgcattcctctgcttcttttgctcagcagattcccccttggtagccagacatccatgcagccataatcctggggccatgctagcattccatgcaatatcagagggagctaatatatcaaagaaaatttaggtatgcaccttatttacatgcttggctcaaaaactaaatgcttgctcaacatccaaaagtatcaacaagtttattcacatttagatacacaacagatgacaacagaatgagaggtgacaagagactgaaggccatgttgcccaaccactgctgcaattgaaaccaatgtaggtgagaccaggcttgtttgttgaggttcagattagaattcagtcctgcaaatgttactgactaacagatccaatgaaaagagagcataattttatctctccatcaaatgtaatttaaatgtatataattgcaaggggtcaggcttgacaaagatgagcttcccacgaagaacggaataaaagatatatacagaacttcaacctgcaaattttgatgtagctgctgccactggacatgataaattccaagtcagttgagtgcttatgagcaccacatgctcttgagttagacgtaaggttaaagagacacggaagagaaactctgcggtctaaaagccttcatccgttctagagtcctgatggtcctcagtgcacatatctagaaaactttctacaggtcccacttctaagataagccattctaagacaagccttcaaacctggcatacaaataaatatggttctcaggatcaaaacacaagtttcatagagccttataaaccatctttaatcaaataaccatgtgataattaagtttcaaacaagacatcctataactctttccctaataacaaagaattaggtgccgatagaacaaaaaaaaaaaggaatggctcaatgcatgaggcttctgccattgtaaagtctagaaagggttaaatgtccgcagctttaaccctgcattcagagaggctgcttctatgttttcaaacccatgacttccaagttacaatgaagcaatcttacccttatgctaaggcccatcctcaagccacacacatcaatctcacacataaatccaaggatgaaaagaagaataacacaaaattatacagtggcataacggataaaaaaaaagtccatatattttaataaaaatcagctatataatgtcagagtaaatgaattgaataaaaaaaaaatcaaagcaaggttatgtgaacatgcctgaggtggaaattttgataaaccctagcttacctagtccctaaggtggaaactttgataacacctatcttacccagtccttcggccaaaaggagcatgatcttcctgcatcagttacagaagttgcattactgtaaatggatatccccaagatcaagaataaatattgcttctacactatatcgttaaatgaaaaatcagacaataagacaaataataaatagaaacctgtagcatttgttgatatatccactgcatccctgatgaattcccaactgtttgttggccaaattgaccctgtaaaaggtttgttgttcaataagagatctgaatgtaaagctcttcatattaattttttttccttttgtgagaaaaaaagcatttagtttagccagcacttctgcaccagttcccaataatatgaactttttcattcatcaccttggaagtccatgaatagagacaagagatggaggaaagaaaaacacatctgtcaatggttattttgcaaacctgtaacaaattggcagactgcaactggttaccaagatgatgttggtggttagcttgaagtccaaaatggctaccaaatgacaggtcatttggattaacttcctcctattgacaccatgatggaagaaaagagtaagcatctactaggtaacttatgcggttataggtgatgtaaatctatgagaatctgaaagtaattttatagaagcataagaaggatgagatatttaagtaaataggagaccattagatcaacgccaccatgtgtcctgatatgactgccaaggtgtgaagcagttgaggcagcttgaaacacattactctgacccccatctgatgatgccctcaaagagtcctgcccagatagtgtagatccggtcacaatctaacaaacaacgattaaaaactaaaagatgaattatcttaaactactcaagtaccttttgattacttggactagatatcatctctgtattagagtcttctttccttttctttggtggacgacctctgcgctttgctggcaaggagttaggaattttgttaccctcaacaatgcccagctgggatgccaaatgattttcatcacttgcatttgacctagtttcaaatgggagaagcctacgttgcaagtctcggcacatgttatcatctagaagagacttttccacttcccttaatagctttaatgcaaggtggtacttctcttcagatatcataccaacttcaacaagttgaaggcaacgcatggatagataatcataccgctccattcgattattacttgcaacatcttttgagtaccgatccaaagcaaacagctgcttcaagtcctttgtccagcgttggagaatgtactgagctggaatttcatacacttgttgcaacttaagcacagataatgcatgtctgcatagtatccctctaaactgaaaagagccacaaatacattcaatgtcaaactcatctacattatacagaacttcgtaattcctatcttgtgccttttcaccaccttccatgaaagcacattctttgacttcgaaggtagagataggaccatcaaccttcacaagcgaaacctgacaataaacaatggccttcaactcatcctgaaattttttgaacatgttaagcgtatatattttggacagatgctcttccatatgtaattttgttacaaagactcggccctcatgaaatgattccaaatctgcccgggcttccatttcatatttagtttgtaaaaccatctcataattacttaaaaaacactttaaagaagttcctggatatacacacccttcaaaaaaggtagttatactttccttgtgtcttgcaatggacatcccggcccagaatgtgttttttaggaaaactggagcccataattgacgattttcatataagatattaagccattcactaccttcgaggccatatctcttcatcagatccctccagccttcttcaaattcattaactctcaacgaatcatatactacttttttcaattccttcttgagtattttgtattcttcaaatccgctcaagttctgttgaacatttttcattatatgccataagcatatacggtgacaggcttctggaaaaacatcagcaactgcaccttgaattgccctacattcatcgataattatggcatttggagggcatcctcgcatgcatgttaaccatgccttaaataaccataagtaattttcagtggattcatctgaaaccaaaccacatcccaacaacactaactgaccatgatggttcactccgacaaataaagcaagaggaatatcatatttattttttaagcaggttgtatcaaaataaacaacatcactgaaatattgatatgctgctctagacctagaatcagcccaaaacacattcctcatatgaccttccacatccaaatccagcaagtaaaagaaatttgggttcttagtctgcatccgtgcaaaaaactggaggatggcttcgtcatcaccctctccaagcttcaaccttcctccttcaatggagtttacacattccttatcaccaaatagcaagtcttcatgtccagccgctcgcacagcaagatccttagtcattccactagacatctttttatagcatctcaaaaaacgggcagttgacggactaactgcatgattgtgttcaagattagcttccaccaaatgcaacaacccatcaccccataatttcactatgatcatagcttggcaatttgtctttgctgtaggtcttgactggtagcatgcatttgcccgtcccttgccccccttggtgcatacaagcactaaccgacgacagagaccataagttgtaaatgaagacttttttacagctacaccaaatcctacatgcagagcataccgcttgtaaaaattaacaacttcttcataagatttgaataccattcccaactgaggagttctatcatctagtccagtgaccttatgaccctcctctagttcagccttgtccatttttccaccatcatcatcgtcattctcaggagcaactgctgtttttccttcatccattggctcttgattgatagaatcagccagcagattctgaaagaatgaaaaagaaccccctaatatatttatttatttattttttaaaaaaaaagacaatagaaacctcatcacatgtatatattgaccatattgcctacagttatagagaatatgacagggtactaattcgacaccaacctgagatgtttcatcttcttctgtggttgttctgtcattcacctcatcctcgttgcagtttttatctaaataagcatcaccattcatcaataatatttctttctcctgattatatctgctttccatgagagaatgattggaattcccctgagagaagcttttcgagtggatcatctatgatactgaaaacataaccactattataaaagaaagcaagaaaggaaggaagaaataaataaatactacataacctaccgctcctaagaaataagtgttcagtggcaaggaagattctccaaatagttttagtgactgaaatataaaagtcccatcttttcattaaaacaaaaaaggttttcttcaacagtaatcaccaatcaaagtttttaaaacctaatatcttggtgacatcggtgggtggctgatgctaagatgaaaccaagatctcagattatctcagccaagatggtagcttgggagaacctggaaagaaaccagaaattctataatctcagctgataatatcagaatcaagatactgaagtattggcagtttagaaaagatgaaattaatcattgtttaaaggccttgattctaatatgcatacaataaaatccatttaaccttgcaagtaaaagattgaaagaaactactctgatacatcagtatagatcagtctgtattgacaagataataagcaataagggttttatatataccatggtggtgaatgcttgatactgataaaacccatagctaagccaggatggaaacgttgtcatccagaaactgatactatggcaaaaaagggggaaaaaggggattgtaatggttgtttggttgtgtttgaggtttatcaaagcagataatcataaagccttattttctgtaaaatggggaggctttttttccccataaaactagtttttctgggtttgttaccggttttcacaagatttttgtggaaagcattcataaaattcatttcaagggtttgtacataactgtttcagtaaaaacataatagaagaatcacaagaacaagtaattaggttgaaattggtgacgcatatcaaataacctaatctaaatcttttgtaaaaactgatagatgtatataagtaatgggatttagcctttcccagatataataatttggcagaagaggtacacaggcaatgagctatataatggaggctaaccctctccaaatcatggaacccccaaatgttgatgaaggcaggatttggacctaggccgctggcacaacgactaagacactttaccagcttggcaagcggcaagccatcgcaatttcagatcttttgagtgattagaacaacacttggaacaggaagataacaggtataagtagagaatctaagcaatgtggcagaagtgatcaaaaaaaaaaaaaagcgaccccattgatcaacacaattatgacagtaaatttcatagcgaaatcacattcaggtgacatgaatttcaagaaaaacctatatttttctctcgacagtgagaaattttagattattaaccatgggatcccgactatcaaagccatggcacttagcatcaatgtaaccctcaatcacggcatctacggtcaaagaacccaagaaagagtcgggtaaaaattcatacaaaaaagattgcaaatttatacctgatacattcaatcaagaatcagaatttgaaacagccaaaagcaataccctaactagaccggaaattaccgcatcaaaatagggaaacggcacaagaagcaaacagtcgattctagaatcccctttatttttccatccttttgcttgagtcgaagagcagaggccggagacagatggggagaggatggggggacggtgggttttagggtttgatcacagtagagaagagggaaggcagagcggagcacaagatacgaagggttgcacccgcctttggacacccgctttagccacccactcagacgggcaggctttgggtgcggagtcgggtgcccctagctggatcgtgaaccgcacgtctcctattcggcgagaccagcctacattccagttgggcccggtatggaactgggaatatttggcaggattgaagattttcttgcatctctgctatgttatattactgagatgttaaaatcctaaccaatatatagccaaaccaaaataagtgaccatgatagacactaattttgaaactattccattaaaattttatttaaaaaaatgaaaaatattggataatactttaggattttattggattgcatcaaccgagatgttagggaccgaaatttccaatacattttatcaggagaggtgtgttgctgatgcaaaccaaggtggaaatcatatactttgttccaccaatatatttttgccattcagtatagaggtatgtaaaaaaccgagcacctcgcaaatatgtatcctttcaatagcaatgtatttagcacaaatatatatgtatgcagtctttatgcaaaaatatatctaatctaagtatagaaactttgaatgtactattgggttagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacaaataccagatatttatcgattgactcctctaacaataaacaaaatttactataatattgttcattttatcttattttatttttgaaagagggactactcttcctttttctatcatatatcaattccaccactcaagggctaacttatccatcgaatatagatgtgaatgtgaaatatttatctaccgactcctctaataatgaataaaatcaaacaaaatccactgcaatatcgttgattttatcttattttattttcaagattagaagaggccggttctgttctttccatcacataccattacaccaactccacgccttcagagctgactttaatcagaagtgaaccccttgctgagacagcaagcagtaatatcacccaaacaaacactttacaatccataatgcttaaaataaattttataatcttttgggatcgatcaatatacattaaaataattttataattaccattgttctaaaatttttaagtacaaattttggattaaaaaatacataataaaagacctccacaaatattttttaatatttttattcatataataatatattagctaaaattatttttcaatatcccacttttctttttcttccttgtgccaaggcacttgtgccgatccatattgatatccttacaacgttgttgcacattcaagaacaacccaggaaaatctacatcattaataaacatggatggatctgaggtccctccacgaattgcggtccaagaaaaaagatatcaatgtgaatccatggtacacctcgttctaattcaagacagagatagtagtttgtccctccatgcaattggatttcttgtcccaccacaagtcatatgtaacagtatatccatcaatctcaatcttcaacaattcgtcccttcccatcacatttaaaatcatttataggtcaggcatgacaatgacagaaaaaaggtgttaccatataagttgtccaaatcacttcagacatcaggaaacgacaaagtagacaatcaattcttagagctgacatcagaatcaaccaaccccctcataggacccattttagtcaaaggctaagaagcataacaatatcgatacgatgtaaacaatcatacaggtgggtaaagaccaactgcattatgaaggaacaagctgtgtatgtttgtagaacaacttccaccttcatactgttatccgttgctcttgcagagtgatgagtcttcattcacttgaacctccaactgttcatacccgcgaagtgggaacactgatacctgaatgattaatcaccacaaacattcaaaagataagatctaaatatgccgctccaaacccatcaaatgccacagcaacatctacgccttaatgatcagtgagtaccgggacagcaataccaaagatgcttcaaattgaagcagggactcccatggatcagcaaaagcagtgtgccagaaggcctcagcaccaaccgatactttacaaggaatacagtcgtatctgtattaagataccaaagattcgaaatgcctgcatagattccaatcaacttcgaacatcagcaagaactcaaagaaatgaattgactaatttgcatgctttactaactcactatttcaagcatcaaaagaaaaggaaacaattgccgagaatcattccgcacgaatatgcaatgcttctactcaaatgctaatcaataagctatttgagacatttacttggtacagcagctcatttattgaatcagttacaggtggttctgaaattatggcttgtatgatcttcacacaagacaattcttcatttgcatcgaatctatagtttgccagggatttcctcttggtgtcaggcagaattatcctgctgaaaccaaaattgaccttgttcataacacgtacatgaatcaaacatcaggttggatttgttttagatcatcaacaatcttcccattacccaaacttgcatcagacatgtacatcactaggtatgtttggtaattaatgtagtatacctacctatgcttagtaattaatgtagtatataacaatatcatcccttataaagtaaaaaaatggtttagatgaagagtagtattgtgagttacagttctaactctaattttattcgcattatatttcagtaaaacaaggcattaacagtttatttggcctaaggtacaagaattttttttttaaaaaaaaaggaagctataaccacggatgtatttcaacttttatgagaatcaaagtattcacacatcaaatcaaccaactgattttgttcaaatagaaagaacatcctaatatatgaattaagtgctaccaatgcattgtcagcgatcactagatgcaatctggaccacgacttgcttgggatttcaatgatgtagctcctggcgaatgcttcaggaagaagtatcatcagagaaacagactgcttgctcctaagaagatcctaagatttccagctacaccattcacttagagaacctctaatgtacgaaataccatccatttcaccctaacccatcttactgctctaacaaaatcactgaaactgacacagacattcaataatgtagcctcagaacactagatctctgtttcaactgcaaacatgaagtatagcctgcacctttacaacagaatttgaccctatacctgcaacattatctggtccccccacaccccccctacccccacaaaaaaaagcatgtaaatcaattttcttctccttatattaggacctgccatgacagttgctaagcacacagtgcattcttgagttcctcaatggctctttgcatgggtagttatttgcatatacaaaaaatccattcctaagttgtagtaccttgttttttcatataagtgatccatccacaagaaccacgcctgtattccttcaagcaaaagtaaaagaaatttaaaatatattgaatattgagttgattacacatgaccttaaactgcacatcttttggctataactatacataagtttcatgatatgaatgcatctttaagaaactgtacaaagtgcttagcttttaaagtgattgactaatttttgtagtttgcatcatttctgcttttctgcttagtagtacatgagaaaaatgaatttctgttctgaaccactaagtactgctaccatattagttgtgcagtagcaacagtcctcacatttatataattacatggacacttaccatacaagtattttcctagagattgtttggcctacaattctcacacgattctaaaagatagacccaacattagcatctcaactctccaatttttaaaggatacatgaagtaaacatgaaatattatcatacaatttaaaacaaaaggcaaggtactatacaaatattcacttagtacaaagggcccattcttttgagggtaaaagatttacccaggaatctgtatttttctagatgagtattttccggacaacatttagacaggaaaaataatttatccatgttcttttatgtattggaaaatgactcaagaatctgttacccatgttcttttgcattactattttttgagaaaaattgctaagatccatccatattttccataataccttttattatacaaatattattatacataataatataatatattattttattttatattattgttatatattattataatatattataataatatattataataatataatatatcatattatattataattatactattatataaatatattatatataatagtataatatataatatattgttatattattatattatagtatattatataaatattatttatatataatagtatattataaaatttatattatattattataatatattactatattatattatattattgttattattataaggttaagagtatattagaaataaattaaaaagattattttttcaattgatgaaaaaataatttagccacctccaggtgggtaagatttctccctttcatgaataaatgctattcatgagaaaataacttatccatcttgaaaagtgtaagaacatggataagttggtcaatgaaaagattgatcaattttttcatgatatttacccacaaaagaacaggcccaaaaaataaaaagaagatgggactgaatgctaaccttcaaatttcatttagtaaaattttgcatataaattgtacgagcacataatgccagtatttgtgaactccaagcggcatgttgaatttggcctgtaaaataaaagaaggaaaaagatttaacatgatacaagttctgttgatattttttgcaaatcttgaggtaaactagagcaaaggagtgaaaaaacaaacaataggcaaccaaggcaaatgcactaatggatgtgtgtgagcatgtgcgagtgaaagagagagagagaatggcaggaacctgaaggtgttgtggtcatgctgctggttcgtcagtaactgattccaaattttggagtcataactgccacttggagcaaacccacttcatccatgttttaaaacagtgtgcagaaagatgctcgggtatatccacctgcattaaatccaatgaaaacaatcaaagcatgaaataggaaagtggcggaaaatcgacgaacaattcatagctcttataccattatcgtttctagaaaggttatggtattatttttttgtaagacaacagaagaaataatgacctgcatccattttacgtaatttgagcatattcaaatatctattttaggcactcgaattaacatgactctactaccaccgcattgcataagcatcacttcaccttgcaaatgttaaccattggataaatgttatcatgacgttttatcatccaaaagctaaacaactgatcagtgaataggattattttgctaatttacaaggtaaataaccaaatggcaagtatagatcaaccagaaatctaggtggctggtattgtgatgcaatagatcagtggattatggtgttataacctttgtataaagatactagactgagttgataatcttaactttgacttagaaatcaaagatccaagatgctcaacattaatggagtgttcaagcctccctagatatacatttcaaatccaatctaatcagcttggaaattaaagtggataggttcaaagcgtcaaattttcaaatttctgatgaagcctccagaaactcatttccaacttgtcttatgcacccatccaaagaaggataagagtggatgaattaaactaaaaaacctcaagcttttccacttacaatggtccaatcccaatgacacgtattgagggtgagtcatcaaaacaacaaatgcctaaaagctctgtatggttgtggcctcgcacaagcttcatagttttcaagaaaagattgctcaatgaggctttgccacacaacctatcagtatgtatcctacaacctgtccaaggatggccgaagcttaccactagtttagggcatatcaaaccaaaccgatcagagaccaacacaattcatctcatatactcaagacagttcgagtcccccctctcctggcccgcttgcattgtttgagaagcccacccttgcagccccgattgtgatgttcaagtcctttatcacaccccaccccacaggcagccattcacgatggtccaagagcaccccccaccttctccagtaagttcctctctctctctctcaatcgaagtctcctccacctccccttgtcctcttcaatccctcctcatagggttccattcctatcccaaatctatccaaatcatcaccatgatcatcaccaagaagccgcacaggatcgacatcctcctcaatgatgaatcacactgggagccctccattgtggttcccctcggccctccccctccctctgcctcccagttgctatctcttcctcttcttttctcccttcccctcactctccctgtccccctccctcgtccgctctccttgtgtcagtatacctcagaaagcaacccatgcatcccaacttcgtatttaaccatcaagaatatcacttacccgtccaaaccccaatccacgaggaggaaggccatcctaacatatggcatattacagaagaaatgctctttacaaaatctagctgatagaaatcacttatgaatacctttcctcccatctgatttgccaggctacacagcaattgccataagtgtcatgcttatcatgttcaaagacctgatgagacatcacagtatttgttaactagaagcattatgtcaaagtgtggaatttatttatgacaaattccatatatgtcatcccaataggaagtggcagcctgtcaggcaccaacctttttttcttctgagtgtaaggggagcgaaatgcccacccaattttataaatttactagaggaatgagagaagtaagaaagagaggatgaggaggaaataaacatcaccgagattaaagtccacaacaagttctgcactagctgaactttgtcattttctaaacagctctgatccctgaataaatgcaaggtttgaatcgaaatggcttatgcaggcttctctttcaataaaaaaaatcctattgtttctttcttcccacatggccccacaaatggcaagaactaacttttatccaagcaacttctgcatttgctgaactttgtcatttcctaaacaactccaatccctaaataagcacaaggctcaaatcaaaatggcttgtgcaggcctctctttctttagaaaaattctattgtttctttctttctacagagtccaagcaggtctaagtttatttactattctcttccttctttaaacagtcccgagggagagtaaggaaggaggattaccctgtaattcattctttccttcaaagttctccaaacctgttcagcaaaagaaaaatataacagtatatggtttatagtcccctcattcttgtcacacaaaagtactactcttccaaccttttcttgatagtacatcccacatctgaagcctatttttgattgccagccacatgaatattcttattttctccagagcggatggagtccataaggaatgatgaataggggatttgtttccacccatgtttaggaaggtatagaatggcttctcagtgaaaacttgtccaaagttgagcttccaaacaggaacttcaggtcctcttcaaggttgatcaagctcaacaaggtacttaattcctcccattctttagattcttcagtagtcaaaggtcttctgattgccacattccagttatttgatcctgttccggaattaagcagtttgaagatggtcatcaatgcagtggcaattcagtaagtattgcattaaggagtgttaaccttccagctactgataaaagtttagccttccagctagagagcctcttatcaaaccttgcttattcttctttttttttatgagataaaatgaaggaagtaagatgcttccttcattaatatattacattataaaagatatgtacatgaggatgatagtatcgaaagttaacatcagcaaacatgggtagatggagggggccatggcccttaactgcacagtaactaggacccgtccctgcctaatttaaagatcattccttagagacttcatgtggttcttatcaaatctttcaaccagatgaattcagtcttatttagaaagccactgttattgaagggaaggcccaagcattttttacaatacgacatctttgtgactttcagagcctgcccttcattctccccaagataaatcaagctcttatggaaattaatacttaaacctgagcaacattcaagactacataaaatcatctttaatgtgagcatacgtgcacaatcagcttcaaagaataataacgtattatccacagagtgaagtctgctgataccatctatattgcccagagggtctaaacattttaaaagaccttgattccttgctctattgaataaaacagttcaaatatccaaggagagaataaagtgtaatggagatagagggtctccctgtctaattcctctgccacagttcatctagtttctgggctgcacattgactaaaacagccatcttatttgtggtaattctagagttgatccataatccactgtgaaggaaatcccctcttctgcaaaactttatcgatgaactgccaatttaactgtcaaaagccttcccaaaatcaagtttgcaaagaatatcttcctgcctatttcttttgacatcatgtaaaatttcatgaacacagataaagttagccataatggtttttccttttataaatacggtcctagcattgtcttttagtttgtcaagttgtgggagcaatctattagccagaacttttgaaatgatcttgatcaagctgtgaattaaggtaactcgcctgtagttggatgcactgatagcttcttttttggtgactaatgcaaggtaagcaatgttaaactgctcgcatcaaagtttcctacaaagaagctgttggagagatgcaagaaatcttcctccaagaactcccaatatttctgaaagaatagcacaggaaattcaaccggccctggtgacttgtcccctcctagagcaaagatcacagttttaaattcatctgagcagaaaggttctgctagagcactaagataaatctcagctgagtctgggtataaacaatcccagtgcaatgcaactccagtagcaacattctcaaaaaaagatcctcttattcagtgttgcgatcagcaatagagcaaatgtgatttctacttttatgattacttgctgttatgtgaaaaaaaaaaagaggaagtatttctatcaccttcaatcagccaatgaacatttgatctttgttgccaatatggttcctccataactaatttttaggagaagattttaattcccttgttccaatgagagattcccagattcttccagtatgtcaatagtttccattattccaaaaatgattttcttttcacactgcatcctccttaagttcctgccccagcctttgaggatttccgaaagtttcagaattagtgatccatgcttctgttatattagattcagattccactccccctcaacccccaccctccacaatttgcaaggcaataaagtctaactcagcttcttttactttactcaccacttctcaaatctaaatatgttgagttcttctaaaaagatgcagttcaataggggaatgatctgaaaattgctaacagaaataggcatcccaagcgagagaacaaaggaacctgaccaattttgccataattggatttttctctcatattactccaagcatattttctttcttttaaacaagtttccaaaagattatgcctcctaataaaagcagaaaaagcttcatgcattttcatttctatcatccacatgccttgtaaaattgaaatcacctcctataacccagggttcggtaaaaatctgtctaatgttatccaattcatcccaaaattcattctcgtggtgaacccttggctaaaaccaacatatactttggtgtacaaattccaatcctacattaatgaatccccaaattgtgtttattgggcaaaacctttattggaatcaagaggtctccactttggatgattttcaagtgaaatgttttttatgacattctagatttgttgttaccagatctatctgtctagtgtttctttgcacatattcattgaatagcatgaacttaactaatcaaaacaacaacagtccattaatcttggttcacaaattaaatgtctctagacagtctgtactattctgtgttgcttctctcagcatgttcatgcattttgatgggcttgcatctcatgttgcattatatattcatatacaaggactctaacaaaaaggactactaatattcctacaattccaccacctttaaagttctcgctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaaaataaatataatgaaatcacacacagaaagatataaaatcaattcaaaacacaagtacaacaacttaaaacaacataaaccaacctaggcccaaactaggagctgtagacaataattctactcaaaatatgactccaagattcactagaaagatggcctcaaaaactagtacaagaattgcaagaaaataaaaataaaacttccactactgaagccttaaaaaaattccaatcccatcataaatggcgtacaatctacagtactttgacaaatttgttagggcaggaagtatttgctgttcctttgggttgtgatcaaaccaccaatttgaccagaatctagaatatgttcatctgtactagcatgtattcaaacaaccgaataagaatttaaatgatgctgatgactaatgatacaaaaaaatataatacattacagacctagggtactttagttgtgtggcccaatatatcacaaaagcatagacaaggatattgttgtaaagtaggaggagaagatagaaacataccatgttccacacacaagaaaagccatctgttgaaagcaaccaacttctcccacctaaatgcgtgccttggcatccatttgacggttcaaattccaccagctcatcaagaatgctctcatccttcccatatttttttctcttcttccttctttccctctttctcttcttatgaccacctctagttgaatctatatcaacactatccaaatcaaatccttctgagaattcatcagatcgtagcaatgaataatcgtcagccttgcggaaagttattctgttcctaataaacaatgactcccatgcctgtggagttttgcattcttttgacaaacaataataaagaacccatgactgaagaccaatccattttactgccaccacctgtttcatctgtatgcattctttcatgagggcccaatgatcggcatcactaaaacctgaggcattttgcagaagctcttccatgtttctcttttcatccccacgctcttcatcaccgatgaggcgtagaagctgtctgccttgaataacaacagcatttaataggagaatttcatcaagagatatgtcgcttttgcatgaggacaaaagattctcaagccagcaagaagggtatacaaaatccttgcactgcatattttgacaaacatatttactgagggacttcaagaaagccaggagcatgcactcgtcaagctgaataaggagatgccgagaaagatatgagaattgctcctccattaaaaattctttaatgactgcccatatatcttcacaattctcttcatacatcaaccgcacaaactgatccacaaaatattttttatcaatctgaataatttcaccatcttttaccgattcagcaagctcatcagatgaccaaaagtcaggtacatattcaagaaaattttccacagtctgcagaacatcaagattctggaagtaatgaggctttgtggcaacaactgctggtgattgcccatgcttccccttccactcgagctcctcccagcacatgtcccggttcacaaaagcaaactgggatattgccctagctccttttgtatgtcctgattcactggcaccagcaaaattatcaaaccactgcaatatgcgtcttgggtttcctgcagttcacaaaagcagataaaatgagcaatctgttgttaagtcagtacgttaaacaagaaaaacttttgcaattattaataagcgcatgcaaaagcaagaccgacaatacaaagaaagatattgaacagaagcaaattttactaccctgacaaggaactcaaacactcaacctgacgaggcatgagtatcaagttttaaggcataacctcattagttttaccaaaatgtctagatcaaggtttttttccaaaaaaaaacaaagaaagaaagaaagaaagaaatcagtatcatggtggctgaccagtaccaatatgaacaaagatcttggtttctctcggtcaagattgaaggtgggggaatacagaaagatgttttcttaaatctcagctgatattttatgactcagatattaaaatataggccagcatcatagatccaagattatcaattattttaaggcatcaatttaaatatttttattgattaaattatatatttaagaaaaataacaatcattgttggaagatattggccaatatgtcaatattatattggtggatatctaggattttgatgatttatattggacaagataacagagaccaagattttctatgcaccatatcaggggagtgtccaatactaatataaaccaagattttggccaagataaagccttggtacagatacgtccgaaaaataatatgaaacaactatagaagaggatgtggccatgtgggtgtgggctttactatgtagttggtatggatcgcatgttccatatgccaaatgtgcacaattattaacagttggtgtacaataacatatctcgctactgcctggaattcagtatgcataaaacattgtggaactatatgaaaagtgactcattaattccgttctgttttgccggctgaacttgtatgctttccacaaagggcattgcttaaaggtaaatgtgaattcacacgaatcatttgatacaatgcctattactttatgtccttgagaatgagctgaaaagaaattttttggatgtctgaccttgagatgtaggcaagcaaaacctctaaacagcttttttccaacaatcaaaccacaggccatttataattatacttaatataagaatgaagatagatgaaggtgcattggtacctctctaaaatatttttgtctaacagaaatgatctctctagaactacaagatgtttcattgaaaagctcctacacatgcaacatattgttgtcaaaaactacaaatgccatagctggacttattcttcaagtactaaagacatcttgtagtgtaaaagcattaatgaatatatgaagacaaaaaccaacagatactgggtatttacagtaccattaggaagaaaagaaacatatttcttggctaaaaagcatgtcaacatttaacaacaaatccaatatgcactttcatgaggtattttctaaaatctgcctttattctgtattatgtccataatccataattccatataatctggatcctaaaagtattaaaacttcataataggtcaagaaacaagtaaaatttgattaagggacacaaaattgccttcaaaaaatttctcaagcatgtagcatttctttgcaataacgtgcccagctttttctggtctcttctcaaaaatcatttgtaggagttgagcagctacatcatgctttaacaggctagacctcaacagctccataaagaggtcatgctgatctcgagtagtaatagtatggaagcgtgagatggtgttgcaaagccataggcgagcctcatatcggccttgagaggtcagtagtgaccagataattgattcaagtttctgcagaagagataacctctccttcacagcagttccatccccactgtcatcagatgctggtttctctaaaaacaactgcaccatctcctgttcaagaacttcaattttcatcaaccctaaggatttagaacaacaaaagaatagcaaaacaatcaagaaaatagaaatgaataaagaacaagataatgtaagactagcagtgatggaaagaaataaagtcgtaattggaaaaaacaagaatatcaccgatgctacgaaaggaacaaagacatcataagcatccagaaaagacgaacagcaattttgttattaaaaaaggaaaaacccttaactctgaaaagaaaccactctattacggtgttaacaaaggtttggtggcggaggaaataattcactaattttctttctttatttttctctgattgcatacatgagccatgttccacgcatggcaaattctcctctactcttgcattatcgattctctaaagcttcctattgacaaattttcctccctagggttgggggacaagcagccagatcaaattatacccaatttcacagatcaacgagacacaagacataataaataccgccaggtggagggatggaaacatacaaagaaagcttctttgcagatcccaccaattcccacggaaacatagcaaaagatcaacaatacctatcggccaataaaatcgatcttttttcaagatttcctaaaaagaaagaaggaaagaagggtaacaaatttttcgggagagtagagaactaagagtgccgtacctaacgaccttcagcgcaggagagcaaaaatcgccggtggccttcggtctctcgaggtggtttacatgagaaagaaataagaaaaaagaggatggcggtgcgagacccgaccatgttcgaacccggctcaggaagtaaacggctcgaggctttcaaatattttatgcccggttcttgattttgatggtcattttatattacgttactcgatccacatgcaagaatgaggtacataatgatggacatgaacaaatctaattgaatgtaagaaacggaactatctggtggaattgaacatcaaatattgcattgctttgtagggaaataaatatgactgattattttttatttttttttggtgtttttctcaaagagagaacaactgttgtgaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactatatatatatatatatatatatagagagagagagagagagagagagaatatcttactagttattgaagtatggtgggtactccggtgatttggctcctgaaataactttggagctgctgcaaaatgaagagaatgctgtacttattgatgtccggccgtggcaagagactgtaaatttcaccagcttcttcttttgcaatgttattttcatacaagaaatttgatatttgtggctaccatgacagattctgcacagctcttttcgatttctggtgatgaggatgtcctctatattcctactaattttcttcttgaatcataatattcgcctaatagccctctaagatattctttcttgactgtaacatagttcatatagtttttctattctttcagaggaatgcataaattaagtaatactaatacgtttgaaggtgagtatcactatagctttggtcatctcaagtggtttattggtaccagtcactaattcatatttatgactggtgtgtattcgatctatttttggtgtctccctcattcctctggccttgtgcatgtgtcttcaaggatgaaactcaaaccttgtggtgttgatgaacattcatccttcatggtaattgttgatcatttctatcaaggtattttgttgccaaagatctgtgtgcgtgtatgaacttcagataattgcaagtttttgggcattttgacaccgattgattgcaatttttttgtttagggttgaagacttgaaagttattcagctgtttgatggttccaagcaatctaatattgtgttattcattttacagctaataccatattattcatttatttttttaggagtgaaagataatgtttcttttccatgagcaacccattagactcgcacctaccaagccgaagctgacatttctagcactgagttctgtgacccaattcatgaagccttagaaggatatttaccaaaacaatgcaatgcaaccaataaattttagaggtgaccaagagtttaaggaccgttccagatccaaatcctcaaccaggaagcaatatgatgggacacatccattgaaaattgctggtttttacatgcctctaatattttataggaattgaaaattcaccttcgcatgcaatgctggtggagattgttacgctgcaggaaatgaactgttccctagaatgtggattgcatgtaacatatcatgttcatattttagtcaggattggaaaataaattcatgaaatgtgagcacaacgatggtcaggatatcttgagacaaaactaataggattggcaacacactgaaaaatttaatggcagaacaaactctacaattccttattccagattagtatcttagaggaaatatcctcatccagctagcataagtgtttatcgaatttagcaaagataggaaccatcttacctgccgaagcagttgcggatccagaaattttgctttataggatcaatataataaaaaaatgaaggagccacatgtagaaaaagaaaataataataataataataatattattttaaaaaataaaaattataaaaaatgatgatgtgtaatatcttaaatattctttataataaaatattataaaggagtatcgtgcgtactgttcatcgcatgatggacagctacagtggtcacgcgtggacatgcatttagagcgcacaatcccacgagatcccatgcagccattcattgtgcgatggacaatgcatgctatcacaacaaatgatgcgtgctcttaactacaacagatggatggatgaaattgaaataatgtattaaaagataaataaaaaaataattaataaaaaaaagagagaagaagagagagaaatcaaattgatgtgagagaagaagacggagagagtgataggatatataagtcattaattaaaaagagagaatgtatatcataattatttctttgattgatacgatctttttttattctttatttcttcaaaatattgtatgaaatataggatcaattcataaaattagtaagatcaattttagtttttcacactaacatacatgcataccaaatatttttttttttttttatgtatggggtcaattgaccccacattcaaccacatgcatccgccaatgtgttgaagaaacaaatcaagggaactgtgcatcagaagtagacccagactccagacattggaaataaatgcatgaaactggagaattgaatttgatattttctttgttttggagaaaaaatactatagtcattttcaccttccccacaaactgcgaccaaccattacagcattttcagggatttgtaaactctatcctgctaatttacatggcatcccaatcttgttttcagcatacagattcttttgtacaaaaatgagaaaaattagtgcctgttcgcagatattcaattgacgcacacaatcaagacagctatgcttttaccactttgggtgcaagaacctttgccatcagtccactcaagctgcacaatatgcacatgcattctgcgctctgtaattcatctgctgatgtgaaaaataccttcaacagcaaactgaactgtgaattactctagagatctgcataaattctttggtcatcatgcttctacttctggattcatttctctccactttaacaagtcctcttattcatgaggcattcaacaaaatcatctcactccttctcagcaatgacaacaaaaacatccttacaagaccatttacatagtagacttttgtctggtggattgataatcgcttgctcagcatttgcaagacggtacccaattacaatttctttcctctgtctggcacgcaccattatttcataaaaattcatctcttcctcctcatgaaggtacagatcagctggtcgtatctgcaattcatttccctgttccaaaggtgtttaggtgcacaatacagttgagaagcatgcaagagaatatcaataagaaatgtggactacttagcttggttcagtatcaattagatgaatctatcaaaataaagcactcaaatacatatgcttagggcagttttagctattggttcgctatggtgacttaacaatcataagaaaggctggtctggatgtttcattttcttttctttgcaggaaggtgtgctggttttgtatgttggaagttggaacaaataatgtgataatgtactgagaaatgggattattcagcataagaataatatatcacaagttgtttctgcattgcaaattgacacaaaattttacatgcattattggagtgatgctattctaattgctcaaaatttatcaatcaaatgccttcacatgctttgggtggttcttctcctagaagtttatatcatacatcccatttttgaactcctagatcattgggctttgttagctttgtccactctactggtccaaaacgtgacaagttagatgcaaggcctagaaacaccaatgttccatgggctcctgtacagcaatattttactggttattttcctggaactcatttacaattagtttgtgtccacattactgttgtttatactttatatctttcaccctttgttttcttcaggcatgcgttgcgggttagacttattcatatctagttagctgattcaatttctaattctttacctactcttctctgtatcatatttgattcttcattataccttttatggaacaagttagaagctctcattaaacattttttgtgacaatggaaatcagggtacttaatgcatcttgaaatttatactcatacaagcttaactcatgtatccgagaaggttggtcttccttgctgccaacaaaccttcgaggttcatggcaagccccttaccttaaaatgccttggcagacttataagatgcctggttaagaaatcttcacaactatctcatacttcaactagttggttagggtttcatgcctccttaagagccttcctttgggggcactctgtctgtagaagaaatggagcccaaaaggagttacaaaaaaaaaaaaaaagctttcaaggatggtagttggatctcaaacctaaatccaaaggtgagataagcctgatcctttacagcatttattcttgataaaacatcatctaacccttctatatgtcattttagcttctcaaatacatttcatttactgtaacctgattctcaaggttagcacctcttagaaagaaagaagaagaaagatccaaaagtgttaaagcccattgagttctacttgtgatttgatgatcttatttgactaccatatttgtaaataaagcaacatcaactgtataatgaaatatcattgccagactcttaaattgacacaaatctcacataagttgacatttaaagttttaaaccatggcaaaaaatgaagctaataataaagaatgcaacccatgctgcgtccaagagctaaagagtacgaagcaggcacttcatagaaaatacataaaaattttcatttatgaaaaattgaaaaccctttcatgaactttgtcattttaagttccaatgtctatatgatctagcatctactgaacatttagttatacagttccttaacaaatactgggaaaatctacgatgtcatgcaaatcatcatcaaagaacatggctgtcgaccaagcatgtgtgcctgtttgagcctgcatatgtatctattatagataccatttaaacacaaaagttaagttcctgagttactgcaactagaccagcagacgtttcagtttcatgcaacatgatgttatatcaagctagtcatattcatttgaacttggagaatgacagccacaagaatagctattttcacaatatcagcaagtaattttttgccattatattgaaaatatctatttaaaggaaactaagcaatctagttcttctatcataatatcatctgaaaatgattgtacctcttctgcaaaaagctcttccaacacatcatttatttgccggtcttccgcaaccattgctaatgccatgctcaccaattcatttgataagacataatcactaatttttgacatggacaataaattcttcgtcctaggatccagaatttcactgattatgacagacttatcggatgcttgctgcatttctccaatccaagaaccttgggagaaacttccttggtgaacatgggagaccatagcttccttataaggaagtcgctttgcctacaacaattatttcaaagtatgtttatcttgaaattcaagatttacatatctaactgcagaataatatctgagaaattctagagctttttccaccgaacaactaatgatattaatatatagttgcagtggcaatcaaactctaaggcagacagatttttgacaaaagttctatttctgaaattcatccacaaatattcataaacaactcgttctattttattgtaacctgttatacaacaaatactatcaatacaattgactgcaagtgtcctatttttactgtttccatgtcttttatgaacaatttaactttttttaaaaaacctttgaaaactaagaaagtaacattagcttgattggtacaaacttcatgggcatgtgtaaagattaaggtaaatatgtcatatgtgtttttatttttgcgacttgaagttttagatatataatcaaatattagaagacaagacgaaaggggaaccagagacagacctgcacagatatacacttgtatgcatgtatgtatatatgcatatgcctatgtatacaagtcattgcttggatgcttatattaaaagaagaaactaaaaggaggagaggggaagagagagaagtatgccatctaacaaataaaaataatagaatagccctgataatgcatgtatctatttctacaagtcattgcttggatgcttatattaaaaaaagaaactaaaaggggagggggaagagagagaagtacactatctaatgaataaaaatagtagaatagccctgacattagtttgcaagttgtttaagttattcattaggtccatttcaggttacttaagatgtgataggacacctaaatggataactaaaagtgatggctttacactaaaacatgatgagactttgcttaaattgtctcataaccaagatgacttatattaaaaacgtaataacactttggataaagtgttcagcacttgaaacagagagtctgttgcataaaactacaaaaaaaaaaaaaaccaactagtcagcacttttttgctgatgtcagcaggatacttagatgaatgtccagctatctcatgtcatcctaccttgtccaagtgtctaaaagtgccaactgccaacacttccagaaaccttaaaatgaagtgtccaagtaacataacaaatgatggtactgcagaagaatatctgctgcttcacatggcacaccagaacatttctagacttaagcacagaacagaactgcagaaaaccaacaaagtggaaaggggcatatgaagaaatcatgcatattttgcaaaatgaaccgcttggaaaaggtataccaatcaaaagaaggcaacactactttattatcctttataacatgcagagtgatgacaaagagcagtctttaagaaatatattcaaacaaaagagaattcccaccaaaagctaattgaaattcaattgtgaacctgaatatctctgattagcagtaacgttgcaagagatcttgaatcagcttgcattgcagagtcttccacagattcatcggccaaaatcaaaatctgcatgatgtttttcgcagatgagattaattcaatatactgaactaccaatcatgaaagattatagatattccacctaagatttaaaattagcagtttaatgcacaaactgattcaagtaacttacagaatcaaatgattctagaggcagactctccaagtgccggcggatgacagcatttccttcacggttgaccagagttatgttttctaatcgactgaagtccaaaccaccatcaattagctttttttccctctcactctcagccacatcattgaacatccacaattctgatcctggtgcaagaaaagcatccaacacctgaaacagtgtattttaagattgaattaatgctggaatttgtttttgtataacatcttcaaccttcaagtaacctgcaataatttatattgtgataaccaagcctatattagctggaagaagcaccatgtagttcaaatccgctaatataaagaaacttgaatagaaagtcaaagtaatttagctttatttttaaacattttcaattttttaacgtgatttttattgttggtctaagggaactatttggagtaggttaaatgtataaagatttactttacgtatatattgggttattggaggtcataaaaaatcgatagatttaattttacaaagcttacatggttacctattatttctgtcagttatgaggagttctggatgtttgtaattcatacaagcttttaaggaaaatgaagaacagcacaatacagcccaatagttggcatcaaaatagtagagacactaccttatcagcatatcatggaatttagtcagcccagggttgattttgccacatttgtgtcaactcatatgttaagaagctcagatagctgagttcccactagcaataagccagaaaatctacaagtagcaatttcactaatggcaggaaagcagcacttttgattttcagcgagtgaaaaatgtatttttttaaaaagaatacaagaaacaaattaaacacaatgatctcaaagagaacttttggaagatacgctgacacatggataaaactttctctgtaaatcaaatgggaaaaaaggaacagaagaaagatatacaatggcaataaaagaagaaagcattcaggaatctgcaataagaaaacaagcttgtcctcaatgaatcttacataagacatgctgaacatgtcaagtgcattgtacaaaagattatcatgatcatttatgcaaagaatataatatattatgggtgaattttgtttttagttgctcagaggatctagtatctctatgtaactgagtttttttcttggttgttctgagtagtcagcaaaacatgccctttatctgacactgactcaaaatgtttcctgatctagggtaagcaaactcccaggtaaccactgagacacctatgaccacataattcaaataaacaatggtgcaagcatcatattgaattcctcataaagttaccataatcatatcttccatatctcgccgccaaccacaaaaaagtatcctttccggagactttggaacaataaaatctttgggaagatatcctctatggacctgcataattaataaaaggagagggtattaggggcttcgaagtaagaacttaccactatcatgtcatctatatcccgtcgccatccacaaagtaaaatcttctggggctttcttgtgggccggacaatgtctatgtatactgcatctttgacctgaatgataaaattgattatgcttttgtaagttctagtagtggtatattttatgttatttatagtttcagtcggatcaaattgacatgagcaaattatagaatggagaagccaggttgccctctgtttatttttctttcttggtcaaacttgataatagatcttaatgacttaatcttttttcttgcaatcttggatccctattagtacaagaaatccttttggcatatgcattccttaggcatgtagttcaggacctcattatgcacaaaagcaaaaaaaagtatgcgtgaaattcagttagaatgcaactgcaccattgaatgtaggaggaacacatattcctggttcactagttttcaactatcctggttggaaaataaagtgtgaaaacttctcctacagctaatatgggtcatagatccacgtagtcagagttacataaaatatgtgcacatatagattgagatgaaggaattttgcacaacaaaccatgaacaatggttgggaatagaggatggaagtaatcagattaggttatttggggacaaaaatactatcccaactcccaaggatttgtttgatcttcattttgtactacagaaagaataatatggattcaacaaaaatgactaaaggcagaggattcagtgcagatgaatcttggcagtgttatacatttgtaatttataactgcattatattttcataaatcaataacaagccagcttaatgaaatgaactagaatgttgaggcaacgatgagggcccatgagcatataaagttagaagaaaagtcaaggatatcgagatgaatgcatgcacttatactaggagagagtgttggaaacaagtgcaatggaggaaacttaggagccaaccaatcaagacagtttggacaagtgcagcaataacagctccagccagatgggacctcttaatataggttgaatctcgatggagaaccacatcaacacatcgatggggtagtcaagaaaactgcagttcaaatgtactggttatataaaggaaccattgctaaagtaggatccaaacaaatgcctcatatttataggaaaagtgtcttgtttagggctttgcttaccgaatcaattaagatttcataatgccaccatttgccatttcaaaaaggatggtgaatttaatcgacatttaattattcttcttgaggggattgattctaaatcaataaactaaaattagctacaaccctcaaaaacaacaaaaattacagatgtgaagagaccagagcaaatctagtaaagtcatcaccaacatatatacatatttatgtatatggtcccttcgaatgccttctagaaactgtctttggtcatggatttcaacacctaaatgctaagaatgaacgaatggtggtggttgggaaggctattcatgccatgccacttgaaacatatcccattggttcttctaaaatgatggttaatacactataaagctcaaagtctacagtatatttttaaatgaatccggattagaaatttagtttccgcttcatacagactagagactattgtcatgtcggggttagtgctttaacaagataccattttgggccaggaaccagcggggaatagactggtgcgtgttacttttttttttttggtacatgcgggtggtcacatcactgatactatttttcatccgagaaatttcccaccattttagcttccttctacttgatcatgcatgcagacttccaggagtcaaaaatcccagctaatcaaaggcattgcatttgcgggagcaaggtaattattcatatgcaatataagaccataagaatgtatagataaaagatgaacatataacagcagttcaccttacctacttgacagttcatctatctgacaattcattgcacagtaccccctcgacatgagggccaaggtagccaattcagctcccatcacatccaatagagagttaatgagacagtaagaccgagtcagataatcaagcacctgccataatgtcttcttctcaagtgatttttatatgttctactgctcttgtatcaagtcaatgggattgatattgaattttatttcttttcactaagtagttaacttagttgtcctcccaattttaatacagtacattctaaaaagagaatcccgcttcctaagatcgattgcccaaaagcatagcatgacttagatgttaaggtgtccagagaaatctgccatgacatccttgaaacaaaaaacaatagtagtaacagatggaagcatggatgaatgtatgtgcacaatataaaacaaattgaatcaactgccatcacatgttagacctgacatatgctagatgtgctggatgcctccatattatcatgtaatcatggtcggtcagtgtgaaaagagaattgcaatgccatgtcaccatttgcaacttcaatagcccattacagtggtgcatttaaaggaatcaagctaaatttgatcatgtcatataacaattatacaaatcagtaatcctctgttaacagttagtaataaaccaacctgccataatatgtatacttgtgatctgtgaggtaagcacattgtagattaaatgcacaggcaagtacaatgatactgttagagactcgaaatgatattgtagaaggtatgcacagtcagctattgtctttagtttcctttgctagaaagaaggaaaattaagtagcatagattaagaggtcaacttagaacaaaaattaacatagattaagagatgaacttaaccatctacaaaagttctgcacagtaagtgaatattgctagacctcctaaacaatgacaacattgaaaagaactgattatgaccaagttaataaacaattaaggtcccagggaaggaaatcttgaatattaaacctatgcacagatacataacattggaaatcaaatggatgaatgggagcatatgcaatagcctgatgaagaggcaataatgtcatgcattcctgaagctagggattgttgcataatctaaactccagcaaaatttctggcagaaaaaaaaatgacagaatagctaatgagcaatcaaagatgacttgaaacatttctatcaaggtactgattatctaaaaaggaaaaggaattcaccataggcaatgtagttggggcataactatcatcatcttctgcaattacaagtatttcatcaccctcctgaagaacataggaatcatcaggattcaaaatgatctttcctccagaagatgccacttttattccacaaggtatggcatcaggaaagctgatcaatacatcttcaaattgcattccatccaactcgggccatcttttgatgtaaaactcacagttttcaaacccaaggatatcttcccagatctgtcaaaagctattaaatgctaagtctagggaaaataaacacaatcaaccaaaaacaaaatgatatcttttgttcattaaagtaaaacaaatccgaccttaaaactacacttatgattagatcactacatattaatttcaatatcaagacttgattcatttgattcgccttgtatgggcccactttttcattgccttaatcgagaaaggcaaagagatacatcaatgttacatctcagatagacaaaaagctatgatgtttacatgcacatgaaacgttgttaataactgctcaagcaagataatgacatcttgaaaatgcacatggcaaaagttctcttcttctcttcctaaatctgaaagaagactactattttgcaatttctaactcatgagactacccacaaaaaggtatgtaagagaatagtatattgatatttagcttcataatgagtgacactaggaacaaacaatccaatccagatgcctacacttgtaagctgaatgttcaagttagaagagcaactgtgaacagcattattatgcgagtcagacaactatgatggcaaaagaaggcaaagaagaaactaagaatacgaaaaacacaactcaatggatcaggttcagaatatttggtaagcatgagaaggtgggggcaaaaacaaaaccttgcttaaaaggagaccaaggaaagcaagaaaagagcgagagacagcatactggaatccgaaacagcactaacctaagcttgatcgagagaataagtgtaaactggaaagtataacagaaaactcaaagcccaaaaagacaaataaacagaaaaacaatgctacagaagttcaaaaaaaaacattaatattgcaaaataaaaatagaagaggggattcttcaataagagaggatttggctagaaatatatatcctatcgatgaggaagttgtccatgactcaagattatacatctgctgttatgaagagcaatctctgttctgcttcaaatttattcttacagtcaattttttaccagcaacgtaagctctctaggtttgtgagtggacccaaatatttttctgttttccatgatattaattccgaaggggatgactgcatccagaggatgcattagctaagcaggaagaccacccagcaaatgcaaggaaatccaaccacaacaaagaaaaaacacaaacgaagttgcttgtcaaaaaaagacaggaaaaaagcaactatgtcacatgatctgaaattgacctgagcaagacctggttgacgagcacactgtatcataaggcgaccaatcacatcatgagcaacaacagtttcaacaagatctccaccaactagcttaactaggacttcattatcaagatcactcaattctaccactatatgtccacttagtccttctttaactccagtcaagcttaaaacagttcgcagtgcccgtgcgtcgctctgtaataaatcagcaggtgaaagaatgataagtaactcttctgacataaaatttcgcaaattcaaaggtattgccaaaaggcccaaaacagtacctggtccgcatttccatcttcagctaggaccaccactgcacgagccttcgaaacagaaacctgttcaacaacagacacttgattcagcaaacaactatttgtagcagaaaatgaaaatcattaatcagcataataaatttcaattaagtgtagtcatattgttgtaaaggaaaaaatatcagcaaatgttgaaatagatgatagaaattgaggtcaagactttaaaaaaaaataggtagacctttttcagatcagcaagaattagaggacttccacttctgcatatgacagatgttcccttgaagtcaaactccattttggcaatatctagttccatttcctccttgtccctctcagccatcactactacagtgcccccacccaaactctcattggctattgaaagttgattcagtaaagaaccctgctctcccattagaagcattaaattatgagaatagcaatgttagcagatatacatacaaatgccataagctaaaaattttatttacagcttaagcacaaaaattcaaccatcaaatgtcatatgaatgccttgcacatagactttaaataaaaattcaaaagatccaaatcatatcttttaagaagaaagatgcgaaaatcttaaactatcgttcctggaaaatagctatatagtcatctgtaacaaccacatgcaggggcaaaatctcaatgccatagagaagcgaaaagcatattgtcggaaatatttcggtacattgtaaaaggtttggtgggttggacttctgattaactgaatcatttcttgtaggtttctggccacagtgcatggttcgtgaataatagagatcataaaatgaagtaaatgacactgcaaaagattccataataaacatatagaaacacgatcatatagatacttgtcaataaataagcagatcacttataaatgaaaatactgattctaaaaagtctactaacacgtagggaaaaaaagatgctgttgctgtattagtttcaactaggtgattttgtccaaaaaatcacagtattagtttcaattcagttatgttacttaatccaaaaaatttacatcctgttttaaccaccattttatatgtgtaatttctctgcactcaaaatatttttctgcaaatttatataccagcctaacagtataatcttttgataccagtataatcttttgaaaggatttttactagaataatggttgtcaaagattgctttttaagtataaaacgttccttcaaaaaaatgcattggccaaaagataactagtctactttaattgaacgacattcagggctgaatttagctaggagtcccagcatagtgtcgtgcatggataaaatagaaccaataaaactgtcaaacttcttgaaatcatgtaaagtaaccaaagagccttacttcgctttagaaacagaacagaaggaaggaaaggagtgcagaaatatgagaataaatcctctattgccacctcactattcttgtgcagaaatatgaaaataaatccagaaatatgagaaatatccaaataagccacctcacttcaaaaacagcacaggaaggatagtgaaaggggtgcacaggaatgaaaaagaacctttatctgttcattaattcattcactaattacatttacgtggagattgtgagtggccctcaattaggtgaaaaatttatggtggatcaaagggttagaaatcagaagaggagaattaagaaaacctaaacgtaaataaaagaattacaatcttcattagctgaggatgtcgacttactgaggtttagaatgcacagatagcatcataattaatgattcaaatggcttgggcaaggcacattagttgtggtcgtggtttcccgaggcacatcagttagggtcatggttttcctaagatttgtgagagaaagaagagggaatgatgtttgattggttagttacttcctaatatcatcaaacaaagcatgcataatagttttgctcccagattcttgacagcattcaagcatttgtttctcagcatgcagatgctgagccaaacttcatgttgcacggaacatgtactttaccagatgtttgcaacaaaaaaaaagttgaaattagaaaaaatcactcacatcaatgatttttctcatccacgggaaccctgaactactgcttctctctctctctgtgtgcgcgcgcacacgcgcgcccaatttctagtgaactttcttgtttcagaatgctggtatattgtttaagaactagtaagattgcttttaacattgctcatgacaagaatttcataaattcttttggctctcaaagtaatttaaactctacagaaaatgaaacagatggttgatgtatgatgtttcagaggactgtcagtagtacttagtacttactaaagaagggaaaataactatataaaagatgcaagaaaagtaaaatccaaatttaccaacttatcactccagccaaggattagtgtgtgatttttctctatgacttcacttctgcccttcctcaatgaatcaaacttctcagagattgtgtcagagacaagcccaagcatcatggcaaatattaacattccaccaaaactgatagaaactgaaactaacttggggctaataccaactgaatttgcatgattacccgaatcagcaacataagtccacgataaccacagacagtctgctaagctatcatctgtcacaccaaagagtgccagaccaccaagacatataagaagaaaagttgcaagaaataaagccaatggcttagcatatggttgcaccgacaaaaatacatcaactcggtatgctaactccttgctaagagaaacctcctcagtatccgcaggcatccttaaccttgaaatgttgtcaaggtgtttaaaagtaatgagtgggatggacagcacagcaagtgaaaataacagagcaaaattttttagtcttctatttagtatatgatcactctcttctggtacaatgccactgctttccagcggatgaaatacatcacatgcctgtagtcttgcattgagcatggagagctggtcctgtaaaacaaaaacataacaagtaaaaactattctatgaatagaccaaatacattttcgcatctatatattttttttcatactggataacaatcaggtgtaagaatgacatctatggaagttacctaaataaatcttagaaaataataagcttccttttcctgtgggaaaatgattcatgaaaacatgcaagcacaagaatgattccatttatagtattgaatagaggcaatttaagtacatcacaaattcataatgcatttgttcaaaaaattatacatgattcctttgttcagttgaacagatgcaaataatgtttggtgccaatttgcttgctggaatagcgcatgccgactgggacaatgagattaacattgcaaatccttcattttgaactctctatcagaaaatttgaggatgggcagattaaactgaatacagatggctctctcttgttattgcttcaggatatggtgggtttcaatgtgatcataaaagtgatattgttttaggtttcatgcctcctctccttctacaacatattcacaagttaaaagaagcacttgctgatccaaagtaatgctctttgccaggcatttctgattcttacatacaatcagagtttttctttcctttctttctttcttttttcctttttttttttgagtataattgtgaaagcattagaacaactgaagccaaatacttggaaccaacactgtgaagatttgaatctagaatctccccctgcatgaaggaggtgtgcaactactacacagtgcttgcataagtttggagatgaacttgagaattccatggaatacattggccaaagtacaagcccatgtgagatgctgagtgcaccatctcaaatatggtaattgatttgtggaaagcataagttccaaatcagtcatctttggagagaggaaaacagatttgtatattttcttgcaggaaactaatgcgcctgttgcggatttgaaatatcatgtggttgaacccccatttttccacataacaattaagctgaaggaaatcttggatgaggttaatgatgctatacatactggctttaacaagagttgtgcttatcctttttagcatcactgatattttaagaaagtgttttttaaaaaaatgtatttataactgaacgattgatgctccacatatttgcacttagactacagccatctaaaaaagggggagagaaaatctggattatggttttccagaatgtaagaaccatggcaacaatctagaggccagaaagtgaagctaattattggtatcagccaattccatatcaaatcatcatggaaagggaatgcaagaacatccaagttcacaaaaacacaacaatatattgatgcaagtaaaacatcaagatttcatattccttgatatccatcaaagccatgaggatccatcatgacatatctatttcagttgttatggcaattaatcatatttgataaactagacataaggaacatagcccgtagatgttgttactttacctgcaaacctataatttgattatgtaatgaaaagttcttgtgaagaagagaagtgaagcaggtgacgataatctgcaagaaaccaagttgcatataaaacaacataaatagacttgaaaatactgcattcaacatatatttggcaaatgatgaaaaatcatatgctctcagcatggttaggagattaatcaatccagcataattcactctccactagatcacatgaaaagttgttatgagttgaaccatagttttgagacactgaatattcaataaattctgcaacatgcacaaaattctgcagataattttaagaaaaaaggagtgaattttaggacatgttattgagtcatcgactctgggaaaatagaaactaaacattagcatattcggtaccatctccgcagaactttaaaaaaaccagaaaagtggctatttttgttggaactaccaatattttaggttcatgatcaaacaataactgtgccatgcattagattttcccacagataagaaacaaaaaaatctcaaatgatttccccacgtcccaagaaatccaacagcacagatcaaatttctgggtccattatacctaacaaatactggaatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaggcctcggttctcgcatgaatcattgaacccttacaaaacgcgcgggaaagggagggagggagggagggaaagagagatggaaatggaaatcgaaatggtagagccgaccgagggctggggaggaggaggagcggaagctgtgcgtagcctggccgcgggatcctcgatctccgtacgctaccactctctcttcggatctcatgatgatatgctccttctcgaggtcgatgagaagctcctccacgatgttctccaccaccggtaaatctttactgtctcctctctcaacgcttctcatcacgttaaggctctttttgttgttatctttttaatcctaatctcctgtagatcttaattacttgatatgggtttgttcccctttttctaaggtttgaaggccctcattttttagttagggttctggaaattgagtctttcatgttctctttgaaaagatgacggatgtgaaattcgattaattgacatctggcccaagatgtctgctgatcgattcgatactcttttttctgaggttaatcgaagccgagaatgtgttgaattgagcttgtgggtcacatgcttgtggcatttctcagttgcaaagaaaacccatccgactgtctaaaaaagcctttcttttttgccaggttattttacatcgtctttgaaacctatatacttaattgtttagatatgtttgatgattaatttttgacgtttggactaactatttaccgctgaaatgacatggaagggattattcatttttagcttttctctcagattttggattttgaggatcatttgtcgtgcctttccacatgcactaattcaaagtttttcatcattctgatgataggatttttttccccccagtgccaatcaagtctgtccttacctttttggttcactaaaggttttgtttatttaggcagtttttccttgttcatttatagacacggctctaacaacaaataggtacatagattttgatttgttaattttagggattgggcatcatccaagaaaattaaaatttgtttgtgattctcatgaaaatgatggtctgcgagctggcctgttggccataagtatctaaggctttcataagtcacccgcattactgggcaaaggaagtaccatatatggcctgttcttttgtggataaaaaatttatctgaaaatctatattttcctaggtaagtattttttagataatatttagatagaaaaataattatccatgttcttttatgtatagaaaagtggcttcaaaatctgttacctatgttcttttgcattaatacttttctgagtaagttgctaaaatttatccatatttttcataatatcctttatgttttttagttttaaaaaaagtcgatgatcgagttgttgggcattgaatgatggaggtattagatgagaatggggcattttaagaataaaattaaatatctactttactgcctgataggaaaatgatttagccatctcttaggtgggtaagatttttctcccatttcatgaataaatgctatccatggaaagtaacttacccatcttgaaaagcatgagaacatgggtaagttggtcaatgggaaagttgatcaatattttcatgatatttactcacaaaagaataggcccttaagataactgggagaggtttagccaaaagaacattaaaactcgtgtgaatatgattcacactctacacaataattgtgtcaagacttcatctttggcttggatgctatcatgatcaagtgacacctacacacacacacatatacatatatatgtatatgtgtgtgtgtgtgtctatatatatatacacacacacacacatacatacatatacacatacatacatacatgtacacatacatacatatacacatacatacatacatatacacatatatacatacatacatatatagatatacatacatatatatatatatacatagatacagatactagagaaatagttgactcatcagggaaaaaataacatgggagatttgaagtgagctttcactttctaaacatgtgtattgaactatgatactagagaaatagttgactcatcagggactgtctttcaatttgtttttctagtgaattataatgcgttctataacacattgtgcatttttctccaaatttagttcatgtgtatttttctccaaatttagttcatgtatatcaaggttcgctatctcggtaccaaatctcgtatcagtatcattctattacagtgttggtgcatagtatagtatgagacagtgagatatattgaatgttaatacaatatgagactacgtaccaatttggtgctggtgtggtatggtacatcaggtgcggtatgatgcggatcggtgcaacaaaccttgatgtatatagataggaaacaaaaggtacataagtgtactgctgagcctaaaaatgggagagattggtcctaaagatatgggaaatatctaaaaggctagcaagaagtatatcttaagttggaatggtctcacagcaacaatttctccccaccaaaacagagacatgtcttggctagaaccagaatggtaatgcagaccttagtgtaaccagaataacaaacaagaaaggaaaatttagatgtaagaactcagcaaaaggagatggaccccatcaaaataaccaacgtcaaacatgatactcctgctccttctgctcaaatatataagcatccgactgctggatagcctagcctgaacccatgttccttcgtattttcatgagtttaaactgcataacaagatgtttgatatccctttataccaagtggttggccctttaggtatcatgacatgctcctatcctgttccaagataaattggtaaaaaaaaagaaaagcaccaatttgagggttaatgtcatgttaagtgcttgttaaatgtccggaatctttggtggattatgacttgatccttaaagctgacctcataggtaggacagcacttgttggttatgctacacggcttcaatgagctttaatctttttaaagttttccccaccatgacacttcaacatcatcttgcaagtaccatatcttggtgtccctaaccatttatttgattttactttttcaatatggcaagatgcttttatttgacaatttttttcaccaatctactttgtggttaaatctattaacttcttgcatacttactaggcaactaagtgctttttttttaaaattattcttttaaattgcaattacctgattttcctttattaagggtgaccattcgagggcaacctgatgaggaagctgtgctttgcactccttcttcaacctatgccatgaagtttgttggcacatccaactctgtattattgatacctgcaggagagccaactccttcaagttcaaatggcacatgcaatggtagcgagacaaacaacaaagcagtccctgatgcagtggcatctgtcatcaaagtggcaccagggtatatggagctaacccaagcagcccccaggcttgataaattgaaatctctccttaatgagagaccatacagacttgaggaagatctagaaaatgatgtatggttcaagagaggcctgtacagatggcaagatctggttgaggagattcaggctagtgatcaggagctgagggatggattgaggtccctctcggctgttgaggttgatgggtactggaggatagttgatgggaaaacaatggatgaaatattaaacatgatcttgaccaactccgtcttgcatgaatggcctctaaatgcactttcagaaaatgaagtggtatcaatcttagaagctgatgggttccctggcagaatcgtactccactgccttgaaacatttggaagcaaggtggagaattcaggaagcaatttgtggagcttagatgaaaagcgggtctgtttgcattttgctgtacaaattttgggtggtgggaagatgaagctggagattttcatggcaaagtggatgcgaagcattccttcaggaatgcatggagacttaaaaatgcttgaaggggaagtgctgtatgaaaagcttggtgtagaaaactggatccatgctttcagtgtctcggatcttccatcaactccagctgagcgtttcgcagcactgttccgagagcggctgaagtgggaatggaaagatttggagccctatatcaggttgctatggctccttaccaagttttcatcgggttgcttctcctgtttaaattttggcatctactcttattttcttgggagcctgacaaaactttatctttttatagggacttgcatgttccgggcctctcctctgaaggtttgcttatcaagtatactcgaagaacacaaccaaatgcagatgttgaaccaattttcagtgcgagatagtcttaggtagtcatatggacctgttttcagcttcttttgcctcaggtaaaaagtgcatcttcagcttctctcagctgttgtaactgttttcgagtccatttttttttaaaaaaaaacctgtttttggagattcgtgtgttttagcaacatctctatttgattatattgctgttggcagaataacttattgttatctttttaaattgatatggggatttgattttgaaaaaatattctagtaagatgaacaataaaagtcaaataatggttgttgttgctgttatgcgcactggtcatcagacacaacagcaaattctctgccaacgagatgtctggttgattaggcattcatcttttcactccttacatggtgaactgtgagaaaagaaatccaaagaaaaagaagaaaagggaagaagaatgtgggagaggagataagggtgttatgtgattgagcttgatcaagtctaggtctgatcaagctggttgaaaattattttcgggcctgaattttgatatcaagctaaatttatacgttatttaattaagtctaatatgaacttgatttcaaaccaagccaaaaacaaatgtaatcaactagcttaattatacaaagtaagacgaaatcagcttaggaattaaacttgattcaagcttaaattggcttctaactgatccatacaattgatgtttaatcataaagagtcaatagaaaatcatagctgttgtttcatagtgagttaatcttagcattgaaaaaaaaaaaaatctaaatttaatatgaatactagttttctaatttaacatcgattctactgatttttatctgataagaacatacctatatattggaagtttttaataaatcctataggcttttgagtctccctccgtagctctcctatctcttgtgggtttggaccctttgaggtgtgtgttttgcactatagggactgtatagtcctaaatggccactacatcatctgtcttgaagatggatgactatagttccatctgtggaaccaaaggtggcatgtttggtggcaaatatgtgtgtgttgaatgacagcaatccatctccgagatggatcgtttgatagctattcaggactgaatagttctcatggctgatgatcctgactcaaccctcagttttcaattttttgataagcgttgcactgtaatgcaaagatgtggagccaccaaaactctcccaacggggattcctgctaccaagcaccaccatactcactgctccagtcagcaacccacctaggatggcacgagggaattcgtgcaattaatggggtgatccgccaatctggcgctgcctactatttttcccagtcaaatactcttagagtccaagtcctctcatgccaaaagccatcttgtaacggctatactgctagtgtgaagcacgggttagccgttgctctcactcgtccccaacggtcacactcgagcccagtctaggctccagcccttcaaataagacctctgcctccgctactctcaccaacctctctctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagactgtaagaaaatatttctaccaaaatgtgcaaactggttgatgctaaaacaaacagaagatgaattccagtttctgccgacattttaatcgacataatgccgtcaagaagcccacataaaaatccaagctcgctttgcatgtagattgtagtgtcaagtgcttaccaaagaccaatattttccaaatattacaaccacgctcatgttgatggtttattacaaccactaaccccaaacaagcaacaaaatccaacatagcatcacttcaatcaactgttttttttttcttcttcttcttttggatggtcacgaacaaacgaaagccaaataaaagggtaagtaacaacagaagttaaatcaagcaatcaaataccacacctacacttgctatttgaacggccttcttccaacgccggcgggcaaagagacggtggagtcgacgctcaaccctccgaccgagaacgtcttcttgtgcttccctgccgtgcccatcctctgcgacccggcgtccttggccaccgagaagggcgacccgcctttgctccaccgcagcgacccgatgctctggccgagcccgaacgagaagcggcgcttgccctcgtgatccgcggccaagaagctgcggactttcgccttggcggaggcggtgggggtcatgtagttgggcagcgtgtaggccgggcagctggtgaggctatcgtcgtcccggaggccggcggaggaggggtggtggtccgagcggcgggaggaggtggagagggaggttttgagcttggatgcggaggcggggcgaggggtgccgcggctgagagggcgcggataggggtgggcggaggaggaagagggggtgatgggggttcgagggatggggatggggcgagaggccggggtttcgggatgcgggtcgggggagaggcggcgttcgaggtagttccaccaccaggggaagccacccgagcggagatcggtcaggacggcgtgggccgactggggcgacactttgaatagctggggtcaatgaaaccagttggtagcgaacgtttagattgggctcaattctacaagctcaaattattgatcagcggtagacctaattatgggccgggctcggacctaaaaatattaaattttatataggcaatagagtttggtatccgaagtccggcccatgatcagctctaatcaatggtaagtgtaaataatgatgataagatgttatattttttctcattcgggtttaaccatggctgctatatatgtattgcacgatagctattaaaaagccttatgaaatatataacacatatagatgtgccaacaatggtggcaatcagatcggtcggacaagacataggttaggtcagatgtatgatggattaaaaattcattaattcaaatccgatctatctatcaaacagatcaaaaatatagatctagatcaaaatattttattgaagaaatagtctagcttaatcgacgatggtttgaaataaattaaatgaatcaaacggttaagcattgccacccgtgtttgccataggaaaaaaattaggaaatagcgggcatggcatttgacttgagttaataggctcctcttatctgccaatggagttataacatatcaactcctaaagctagtttttatatcagacatgcatatctcatgactattaagcctgtgcattataacaggaggatgtctacttaatttccacctaaaatttggctaccatagaatacctatagaagaatgaaggtaatgactgaaaactcaaaaggctagatccatggcctctagtgcttcatttcaagtatttaattcaacattaatttgattctaccaggaagtgagggattatacctgatgagagtaagcataggccagagctctttccctcttgatgagtgcctccacctttcttcgcattcttgcatcaacctcctccttcgttagcatgctatcatcccactcctcatggcctcctgcctctgactgcagaacatacagcatcagttaggtccagattcaaagatcacttccaaacaggagcaaagatatgatcacagaaccatattataattgtcagcttagcatgtaactttgtcaatgttatacttcagctagaatcttttaaatagccaaataacaaattgagcaagcttgacctttcttcttcttcttcttcttcttctttttgttgaatagaaaggtgtaaattatatacagtgacaaatagaaagctcaggtattcagtttctcacacctggtgagttatgctccatttgccaaagctgctttcaaattccttgtcactctttcgtggggtctggtgctgttggatactcctgctttccatcatctgcagcctcctcgtacgtatttgtgattggactcttacaagcatctgcatgcatttcattgcgttcacggtctgacgcttcacactctgccctctcatcacaccttgaagtcttatcaatccttttaatgctcggtagttccttctagccttcaccatcaaagccaaacttataacagttctcttcattgcacattaattgagatcatgtgctgaatttgatagctaaatcgcttgtagattatggttatgtgtgtaattgaaacttggtcaaaaactagtccatgagactctttttcagtgatgctaaagtgcctaatgttatcattgcacatggaaaatagcacaacatgcaagatttcgttacataggtaccatccctataagctgtcaagaaataaaaaagtgcccattctgtaaactaaccattcgttcattctcttgagagttatattggacaagaatattggatctatccatacaactcccaaaatggcctcttcacatcattgtatacatttactcatcatcaaaatcatcatgatgtgaaaaatctaaatctagcatgatctcttccttaattttcagtactgcatatcattcagcatgttttgacttatggcaaggaggtttgaatgcaaaacaacctattgtgaaccttctctaactgttcaataaatagtttatatagaagacttgatggatgtatgttatttctaatgtctatcacataatcatacacttcgtgattgtgagcatgcatgtaattatattttgaagaatgtatagaatatgtcagatttatgctcatcataaaccctagaaaaggcccacaagtatgagtctatgttaaaagaaagaggtgatcttaggtgtgcttttcccaaattcagagggtaagagtagtggacttaccaagtaacctctataggctgcttggattttgattgctgacatttgaacatagattggagtgattaatggttttggtgcaggtgccaacaagtgtgcatgagcaggtgcatttgacttgagcggctgaaccttcttttgcggtgcttgttgtatcctgtggagttgatccctctcagcatcacacagtatctcctcaatgctgcttggttttctgaagaggggaataaaggaattgatctctccatgctttgatcttccaaatccccactttttcttctcttttatgtttttcttatctggcacctgcacccaccaccaccttagacaagtattaagagaatttaattgttaagtaatgcatgtaatttataggtaagagatttattggaactacaatgcatgaaagaatttgtgctttacatcaagaaatctgaaagtctaaaacagggttaaaaggtcagaattaactatattggatagtcaatctgaaaccgacatatctgttgcaaatgagactttcagtcactgcttaaaaaagctccaatgtaagaaactttgtgcagatcatacaaattacaaatatgcgaagaagcagtttacctgtcagtacagatgaaatatactgaaaggcatgcaaaatgtctgaattattactactatgtgattttttcccctcatataatatggatatatcttcttccatatttcttaaaaaaagtagtgtttaccactccaaaaatttgatgttatgatttaaatataaaacccttttctccaaccaaattgttgacaaatggatttctgaggctccctagtccaggtgaggtttttgtaccaggagaaatcctagttgaagttggaatatggcaagttaaagttttaggcaatggaacatggaatactttctgacacatgaagggctttacacaaacacagacactgcacatgccaagtaatgattttgtaaacctttaacagtaagttacagttgaaccttccatggatgtaggcctcctgaggaatgtccatcgaggcatctatatatgcgggctttcatattactattgacaaatcccttaaatccagtaagttttactttcatcataatacttacatcgatcagcttatctttatctttagagcttgaagtgaaggcccttttgagagctgtaaaccaattccttttttccccatctccttggcattactagtctcagctcaaaagcctgagtgcaagaattaaaacaaggataagtacaacactttttgctttgcaaatttatatgtacattaccattgataagctttgagattaatcggtatgtatgttacattcataaaacatttggcacttgtacaggacttcatatatattctgtcacttagtagaactcactgtttgacactatctactagcaggtaaaggctctctgaagaattacaattaaaataataagatggtgattatttcccctagctggaagcttagagaaaaaccaccttaaaagccaactcagatattgacaacaataaagaaaacaaggtgctgctcgctgagttagtttggaaggtcatttctgcccttcctaacaagaaattcttcttcttcttcttcttcttattccttcttttaattttttttatatgttcacctccttgcaaaacctgtcatgcaaagattcgtgacattttgcaaagaaatttaaaaaaaaaaattgctaaactgaactgaagtaaactattggactaattggtaaatggaattgggagtcattggatttaaataacaatgataaaaggatataagaattctcaaagtgatgcaaggtgaacatatggaagtttatcttatccttttccaacacgaatccatttaaattttcctcaatcagtttgtattgcaagagactacaattcccaacttttacatgctgtttcttctaattctaaagcatccattctagttttcacagacgcgaccttttatatttaaattagagatcaagattgctaaaatctttgtgcccttttttgacacttaagaataaatgccacccacaatagaaaatgttctgacagcaaaaatatggggtgcagaatgatcatccaataatcaaacacaaaaaaggaacagtcaatttccttttagcagagaaaaccatcaattttttagaaaggaagcctgagaaaatttgatacgacgagcacgtttatgcagccatctctcatcaattaatctcaaaattatgtaaaacttctgatatataatagagctacagaaattaagcaaaaaaatggaagaaaaggaagaaatcttcaacaccctcagagagttcttttcattcctaaccaaagttaatccatccacttgcttctgaacatctctccaattatcaaaaagtagcaaataatggagcaacaccagaatccattgaatagataatatcacacatccaaaagaaagaaatttatagctctctggtcttgtttctccagttaaattttaattcattgggttagcttagagccgaaaaaaagattttgtaaaactccagccatctctgcatcatacatttatcgaaatgcacacaacagaaagagagagagagagagagagagagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagaataaaacagagctatatggctggtaccttggccaaactcccagaattacttccaaagctaaacctattgcactggaggaagagatggagacatggatttaacttggtaacttccactcaccctagacaaattgctcctgtgcttcactaacccaaaattatatcctatatgcttttttcttttttctcattcaaggaaccaggcatctagttcttccttgcaaggattgagatcccttttatctctcattttcagcattttttgtgaacagggagtgtatagctctcttttagcttgatgatggagaaggtggccactttctcactccatgacccccgaccaactttacttcactagaaagccttctgaggtgacagaggcacttaaggaacagttggttggcctccttttcagattactgaaaaaattacaacactagaaatgcggagcagcaattataaacagaagcaggaggttgccatgtgaggcaagcaagaatgaacaggaccatcatttattagattcttgccttgcatctggagcatgtggcactgagctggccatccatcatatgggcctcaaaatgtacctgaaaacccaagatggaccacaagcagtcaccctctgtgcttgctttggatcttttttttccatttaaccagtattagtcaagaaattatggggttagacatggtgtggttattttagtatgtagtggactcacatgctatagaaagggcaaagtgtctgccctttaatgggtaggaaatgtgcttgttaaaatggatatcactgtatctagaaacatgctttccctgctgttagattcttgtagatccactactctttcatcctgttagtgaccccttagcttagggggggacacaggaaagagactgttggatgtttgcttacaagctactcaaaacaaagttgggtggttctcttatccaaatcaagctgcttaggtgcgagggttgttagtaactactcttgtaggccatcatctccattgtctagcctcaagcataaactattatctccatttgtctctttataaccgtgatgaattattcatggttggcctcaaacggcggcaaccttgttttattgtgtgaaagatactttgtaggagatctgaaatactgaaattggctgcttggccttgcctcactcttctttcttcgttaacgatgcaaggtactctaagcctatccttctaatatcgaagataccgtctaagatcaacttggatttctctcctcgttttgttttgctttagaacttttttttgtttcacctggatgtgagatccattagagatttggggttgaaaatctaaatgtggcactaaatgcgaggtgcctcaaaatttgagactggtttggagcatgattcttgtacaagtttacttcctaaaaagtgtaactgttgtagtaacaatcatttcaaaagaatgaggacagaattacctaggtctttgacgcagaatgccgaaaggggaaaaatcttcttaaattttcacaaacttacaacactacttgcaaataaagctatcatacaatggagctattcttggctgtatttgcccactatgatttaccattagttgtatcttttttttgaaaaatacactggaataccattctttggtttcaagtccagaagcttttcgtaatgctttataaagagaagggtgccaacctgtggaccttgagtccagtttaatcacctatttgtcaaatcatggcaatcaatattttttccaacttttggtttgttgtaggtgcaaattttgatgggactccaaatgcaagaagcaactcacaactcttttttttttttaagatgcaacgtcccaaacactgatgcagaaatacatgcatgcaactctttcaagacataatttttcaatgctgtgagtttaatcattgccaaaaagattgttgtaagtgcacaaattatgtaattctagatttaatgtgccaacttaaatgacgctagataagctatggtcaaggggatcctatgtcaaactataattgctagcgtccattgggtgtagtttagatgcaataggatgtagcatctgggttgtctagacgttcacaactgaaaatgtgcaatcagatatgatctaaccagctctagattggaccttacaattttgcccttcagttgatacacactttgaccacatagttaaggatcctaaacaagggtggatgatcaaagccttaggactcgtttggtttgcggaattttttttttaaaaaaagtaatttcttaggaagtaacttgtaactttttgaggataggattttaatatatttggttgatcatgggacgatgacttattataaagtagctttatgtttgaataaacatttatttttctagaaaaactgtgtaaaatacctattatacccttagtagatataaaatcatatatttttactcataaattttatataaatataaatattatatttatattaatattaatataaatataatattaatatatattatacaacattagaccataataatttattgtattaatataatactaatatattaatattatttcacataatatgaatattttaatataataaatttattaatatagatataaatatgatattatattagtataaatattatattaatattaataaaaatattatattaatataaatattaaaataatattaaaatataatgaagattaatattatatttatatgaatatgaagataatattaatataagattatattactattcagtatttcatcctaaccatctattgatattttactaaattttaattatggatctcaaaaggatattttaggaaagaaaaaaatactatcatttttcatgtcacggaaagtgtcaaaactcactttctctatgggttttcacttccatgaaatgtgggaagtgactttctatgagaaatactttttctattctttctcttcataaaattctaaccaaacaagaggcactttcttcatttctcagaaagtgcctcttcccccacctctactttttgactttttatcaaccaaatgagtccttagtggcacttgaagatgccagaggctaggaatcttaacagccaaggaagaagacataaatatggtgcaagtctgcggcgataaatccccgaagttggtggggaatatagcctaacatttatcaatgttccatggtatttttataaggaaaagggaggtcaagccggcactgtcaacagtgaaagataggagacaggatgggctggggagttgagtagatgggacatttctttcaccaagaaacaaagcaaatgatgccatcaaatgatccctataatgtgacttattccaaccttttcagaggccaacatgtttaagacacaaatgaatccaagccattatatgttactgatttcggaaaatgattggtgcaggatttgctcatatgcatataaacatgatgaaggcatacaatagctaggcctatctagtatatacattatatttctcatggctttcaggttggatactgaaaggcaccatcattgtttgtggaacacatcatttggttcaaccctccccacatgctagcaactaggacacgatctatgtacacgcactgacaaagtttcggggttcttctttgtatgatggtaatgccactttggttttattgtcgaataaagcttgagtgggcctgcactgaggcaaactcatatttgttcatgaacagcttgttaggcgaccacaacccaatgggatggtcacatagggaatcttgcaaggaaaatctgctgtccaatgacaaattggataccaaagagattattatgcctctcacgcagccttcaatcaataataagttttgaaaggaaatctgttatgtatgtctagtatgctatttatgctgaaacatgtaatagaaagtagaaactattgaaacaagtagtagtgtggattctactttgagaggtatatcattgatctccgttgaagtcaaatatctcggaagcattctagtataactccatgtgtatttcaaagttcgaattatttatttacttcttctgcaccctatagttttcaaaccatttaacaagacctttcagtcccgtcctctgcattgtgtagatagattctgccccaaatcaaccgtttctcgaccttaatccttagaaaatagtaatgtctcgcaactatcattgccctgatggtgcaaggacttatttatcaaacttgagcgacgtcaacaccgcatgctgataaaattgcattcacatcactgacatcaacacgtataggtgcaactacaagcgatagccaattcaattattgattgaactagcacactttgatgcatgattctaaatatttttttaccattgttttaggattcactatacatacatatacatatacatacccacacacacacacacacacatacatgtttgtgttttatttgttgatagcctttggctgatcatacaacttgaaagattaataaccagaagtaggaacatcattgtgaaccgagatgaaaccaacccgaaaaatttctcaagttttcaaaatcttatatgttaacgagatgacagctcatagttaatttgttctttttaatcaaataatttctagtatgctatttcttgtttaacttgtagtaaaaacatattttagctactcaaaaaatattactcaacgtatcgcttggccaatgttgtgtattatttaacagagaactagagataaattttcagctctactttcaacttaaaaacagccccccaaatgagttttatgtaaaaatatctactcattccaaacataagttaagttaaaagcaactacacattttgactgaaattatccttatactttttaaaatactgcagtattaaattattatagtgcagtattcctttacaataagatagtatttagaactgtcaaaatggaccggcccgatcctaacctatgtgattatatgggctgggccgggcttggcccacttgttaaaatggattgtaaaaacccaaccctagagcacgtaggctgtgggttaaagccggaccagcccacttcttttttttctagagtcggatcagcccattctgaagttactttcacagttttctccccttattctcgagtcactatgaagaaaattaaaactcaacacgtaatgagtaataagaaatcaagtagcaacaagattttcaagaccaaacaaaaactaaacttacaaccaagtgattacctattcgcctgatcaggtatgggccgacccacggactaacctggccctaacctgattaagcccatgggctacaggggctgagtcaaaaagtctactgtcataaatggatcaaaatttctcgacccaatccgatctaattttagggtcaaatgagctggtccatagatcctgacccattttgacagctctagtagtattacattatattagtgtaatatttttttataataatacagtatttctttattgtattatattaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatattcctttacaataaaatagtattacattatcataatgtagtattactttataataatgcaatattattttataatagtatagtattactttataataatataatattatttttattataaaataatattattttataataatataatattatcttataatagcataatactgttttacaactacaaagataattaaatcatttcatcccatttgagtagttacttttaaattatatttaaataaaaaaattatttgaaattaaagtagataaatatttttaaatttaaattcaattaaatatttttcattaattttttctatcctcaattgatccctttacattggtaccatcaatggtgcaatttaagagcatggcaactttttaaagcaatctcaggaacttttctgtgatttttccaagttaccgtagcattgctctttataaaaaacctatcacatttattgcgcctagctcattcaagtttacataacaacctaagaaacactagtagaaaaggaaaaaaaaaaaacatggatctaaaagtgtacaaatataaaaattaattttgaaaacacggaagtcaaaataatgccatctcaaccttctccataaccaggtgtacagaaaaaagaaaagaagaaagcccttacattattttcaagtatattacaactttaaaccagatacaaagaagcatgataacaccacgcagaacttaatagttccttgggtcaggaatgaaccaagttcgtgtctagcaaatcctatcagaactctcctaacactgaatattaccacaacctcaattgttcagttcagcaagcttttactataatactagtagggggaaaatgagatacaaaaggaacttcaaaaaaagaacatatatgttttcccagagagagagagagggcatatataagaaaaagtactttacatttgacatgttgcatatccctttgaataacctgtttatatgatatgtacgagataatgttatacagatgtatgcacacaccacaaattcactcgcactgaggcagggtgagaagacagcacaagtaccagagcaggccaactgttgtaacatggttgctgttgcaatggctcgagagatgggacttcatcaaggccccgaatggtgtgccaaatgagggtgccaagcaggcagactttgcatgaggatactgaggttttcaatcaccttcagcaggggaaggagttattgatgcctcatcaggctcttggttggaagcctgggccttgagaaggtatgagcgggccacttctaacatctgggccacttctttcttgtactgtagacagaaaaagaataagcacactttatatgcaggtaattaggtttacttttgcacactacatagttttattcaatgaactttgtacataatcatatagaggaacattagaatctgaacttatcacatgcaacttgaacaatatcatcagttactaagaggtacaaaaaaactcacatcaaattttgccatttgctactttaccaagtaatatgatgaagcctcctaaatttttaatcaatgtcgtgactatctctaaatgcctccaagggtaagagtacgaaaagtccatccaacatattccagtagcatgtagcagatacaggtgaaaagataggcaagacaaaatggagatgtagaatcagttagtacaacagttgaagttgttcaaggacgaggtagcatgtgcaactcaatacaagggcacaaaatagggcacacataacaataaagaacagaaattcttgatgataccgaggcttggcccatcatataatgtccctttgatgtatatccatgattttttgcaaacatagttttgcagaactgcatttgtagcattaactagagtgcagcatgactcaaaatggcatgctcctagagccaacggtgggataaggttggcataattcatacgagacagtatgtgcatgacaaggagataaagcctaaagatcaaggccaacataagctaaatatgaaggccggctggctacccaaataaagttgcattgagataatggatcactacatggcctgtttggattcactcataccagctgtttgaggtaggggtgcatgggcttttgtcttatccagcataattggcttcagttgcagaaaaaacataaaacaaaacaaaactaagggatggctatcacttcaacaaccacagttttagaagtgtccacaatacacccacaaatatatgagagagaagcccttggtagactgcactatttagaaagaaatgaggttttgcgaggaatactatgatttcatatgtcagagagctgtgtgattaattgtgttgatgaaaaagaagaggtgtgcttaagggtcattggtattattaaaatacttgaattacatgtgataaagcaaaatagactgcatagcttcataattaatccatacaaaacaaatagagatagtgaactgctttgtcgatcaacccctcaatgctaaacaaaagaactgcaacagtacttggaagaacattcatgtgtttgcaacaaacaacatactgatatgtatatcagaaaattgtttttaacaatcttttcagaaaaaaaaataattgaattaagttattaatgggcatatgtaaaacgaaatgtcaaggtagttcaggcgaagtgaaagaatactgaattatgttggtcctagctcctggaaggctggaacaattcaaaaaggcttcaagacatcaggaagcagaggcaagagtggaagtaggattcactagttcaatgtggccacctaagatagaaggttcgcacaactagagtggccttgcatatgagcaggtgttcatgtctgccctgatgaacaggatctctatctactactgttccataacatatcttacccatactgttgatcctctttcaaaacaagcaatgaagataaaaaaactagtgcagaatacataggaagcaaagtggacaaaggagatgaaaatgaaatgcaaacctcatcgacagctccagtctttatcttagactgcataatgcaccatctcttaaaatgagcacctgcaaaatatccaaaatttgctttagttcttttcattggaggtaaacggtgctagcatagacattaagaaaaataaacatctaaaactggaagacaaaagcagatagacaacaaggaaaaaaaaagggtagaagatcgaataactcaccaactcttatgtcaagcatacaagaagactcactgtttgttttcaacgaccatctgcagtgtacctgaaacggttgaaaataataacattattctcccaaaacttcgagttgttgaccttctttcacatatgaacaaatgaaccttatagatagatcaagatgataacattgaattaaacaaagggtggtgatgcaagtctccaggtcatttgatgcatacatagtggacattatagctcagtacaagtgcaagagaatcggatataaagccagtcaaaatcctccatatgatcataccatttgaaggacaaaacagtaaagtctcatttaatacctcaaagcaggaaccaaatggaatatcatgtgcctgttgcactgtctcaaaaacctgatagaggaaaatattgtgaattaaatgaaaaatacgcataagaggagatttctggagagcaaactaagaagaatttgaacaagccataataatatagaaaaatatcttccacatttggctttgagagattgagtcaataaatcacaccaaagttgttttatcggatgaaagaactgcattctgccactccgtcatggctgtgtccgggggacacataggactatgacataatgttctgaatgttatttctctgacttgaccatcatattcatcagcgacatgccactggcccaactgtaaagaaaaacaaatactgagactatgataaagaaccaggagtaaactaatattccagtggcatctatgttattctctatacaaacaaatatagcaccatacgcacatcactatgataatggtatgcgacaggacaaacaaacaggcgactacacatgaaattgctaggatgtgaggcaataaaaaggcatttggaagatgataatcctttgcatgtctcagttggcagaaaggcccacttgtggggcattccatgtttgattcatgtaattatatatgatgtattgcccaacagggcacccagaatgaagaagatgatagcacctctttctcacaatagcaccacatgccttcaggtgaccaaaagcaacaattggcatatcaatgaatggcaagctcattgaagcaactgcatgaagctttgccacagacatacacacaaaggaaaaaagggaaacaagaaagccaattacataacagaatctatcagtgacagtcagcagtcaaaagctaatgaatttcatacagcagaacttcaaagacaataacatgagagataatcattgcatgctgacacattacatggagatttgtatccttccgtgcagtgcgatattcctcaataaactttgagttgtcacccaacagcacattaaaaaactgctcagctgtgcatggaaaattatcctgggacaagattggtgaaacaaattagataaaagtaaataaaatttctgaaatcaagtatctgttatggatgatgaggctgatgtgtacattaaagatgccaactagaacttcttctttaatgaaatcttggaaccttcctgccttctcaatattatcttctggaattttaatctgttttctactacctctgacagagctactgtgtgcacgcaatgctgactgtgcccactcctacatttccaaataaatgcaaagcgttaaaatttttcttttcaagtattatatatgtgaagacacacaatcatagatctaggctccaaaacctaaaccatttgtccaggtaccatatgaaaaacaaacagcttactggatattggagaacctgccagatatgaagccaatgcagaaaattttattacagaagcaagcacaaagtagctttgaaagacattcaggttgacttggatatagttaacctgatcagcattactaggcagtaggcaagatcaccacactggcttattgcattacaagatactaaagattaacagaggatttaaatcctaattatgcataaatagtactattcttaactgatgatcagttagagaagaatgcaggcataattatggagaaaaggagtttgccgcatcatatatcagaattcaagatcatgcccactaaaacatcagggtaagaaataaagacctgacaggaacacaaaattaaaaccaaacttggatcacagaaagcagcaatctctattagaagcccaaaaggataatatcctcaatactccaagacagaacatataaatgaaatttatcttcaatagtgacaattgaagagaaatttcttaaattgtaactgaaataggaatttataaattgaattagaacaataatgccagaatctttaagattaatattcacattcccataaaaagattcaaatgctgatagtctttgtactagttttccaagccatgacattaatatagtaaaataaaatttcatctaatccataacaaaaatttaatgaaacctctgcatattaaactataataagtgcaccataaaactagtgtaatgtcccgatgcttgggatgcaaaatagtagtctaataatcatagaaagacaaaatactggaccaatttctatgaggaatacctgcttctcagcttctaacattgcacggaaattctttgttgcacgttgtaaaattctcagtgtatgatttctgttccaaaaagatgcgaatttgtacctaactcttcctgaaaagcagaagatggaaacatgcaaagcagttaacatctcatactgggttccagaaaaaattgtccaaagcagggtgcactaccagatgtttccagcagctattttcataaaagcatttaaaaaatgcatcattgcatattcaaatacagattaattagtgaacgagcatgataaaaacaaaaaaataaaacataaccatgaagagtcactggatatgttataacatgatttcttttctttcattctgatcaaaaaattgatcaaccattgcaacatatatttcaagtttaagcaaggttttcccaccattatattttcttatctgtgagcattgatgtacatgcaaacatgccagaatgcacaaattttcaaaacatacatccactgaagaaagaattgaatatccaaatgttgctatcagaactctcattcattcatgggccaaaaagcaaagagatgcttctatgcagaagggatgcagtaaatgtgacaacttgaatcaaagattaactccaacatgaggcacaatgacaagagcatgattttttttgaatgcagagtaaacaaaccttctcagattatactacaaacatgaagtttccgagactttgattgatatgcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacccatgaagagagccagctatgtttaggcttaccatctaacttttcatgttcttagccagcaagccttcgatccatcagaccttataatcaacttacatcatctttaaatttagaaaggtattacaaggttcccacaaaaccttgtaattaccattcaaaactataccaattaaacccatattttcagcatggcaatgaatcaaaaacatcaagagaaaatgtttgagaacattgaataaatacaggagttatgtgaaatgcagcccaacagagaattatggtaaacttcacaagatagatctaaaacagagatgtacatactcgcagaaactactaattcacatctatgaaacttcatataacaaaagcatgcccaactaacataacacaacaaatatagtggtgaaactaaagagcactccagttgcccgaaccaccagccaaaccataatccccagcccaccaacctccacacacagaaaaaacactccatgtataaaaagaatgagaattaaaaaaaatgagcaacaaagtgtttgtgtaaaatttttatttctcttatccagaagcactataagaataaataactatccataaataacacactaatgcttcaagaattaagaaggttacatgagcaaaaaaaattatttagctactaatattcaggtgaaaaacttccttactacataatgaacagaatgctaacaaagggaaacaaccagcaggccagaactgaaacaagaaatcacctggcagtacttgcaggaagctttaccgttcttatatgaagacaaacctgggaagaagttcttttcaataaaaaactaattgcagaaagatccaagcatatgatagtttatgtatcaattataaagtaagattctacctgtcctgatgtgctatccaaagtgtaccagatagctccagtttggacttcactttcaactggaactgtcactgatccaagaactgtgcttttccatattatgtcccagtcatatattgtcacattaatctgcataaatcgttgaaaataaaatccaatataataagactacacagacaataacaattttaaaaaagcattaaataataagtgtgactgaattgaacatgcatgtcatcactatggacaaggataatgagcattctacaagcaaataaaagatatcttatggtcatatactatcttcaccaaaatcatatcatttaagatctttttgtacgaaaacaaggcttatgttttggttgtcaaaaagtagttcattaagaaaatcgatttccaagtattgttgttgcatactacttatatgttccaagctatatcacatctttatcaatgcatgcttgtagagggcaacctatgatgatataggtgccataaaccacactctcaacctcacatgttcagaacctttggtggaccaaataatatagccagtggatacaatcacaatcaatgaactatatcatgattagtacatcacacaaagttatgcaataaaacttgtttggtgtattgaaggagagcaaaccaacacaattatgcttgtatatctcaaaccatatgattatatcctgatgcacaaccacattacatgtttattacaccacatcgtattcagaacattatacagaagtgttaacactaaattatgtgtctagcatgccatgcaaatgcttcgtgatgcactgacataatgtgatcaatgtgtacgtactgttgtacatggcataagaggcaagtaaagattagcacattgtgaagtcacaatatttaggaactttactatagtgtcaacaaagtcaaaattaattctgtccataacagcacacagggctgataaattaactctttatgttttgttagggacaaagtctcatacaaagggtcaatagtagatccagaaacccttgagaaaatatttctatgtcgttatattatctgatgacctatttcaggtggactgcataaacaaactaatgtaaactaggaaaacggggacatgaaataacctggacaggaagaacatcaacaataaaattgaactcctctccccaaattgggtttcttgagcctggtaccattgagctgcattaagatgatgatagcaaaattgtattgaggcccacatttcatgataatttcgttacaccctttgcctaaaataaaaagttaaaaaatccggctaacaagatggttttcataacaccatatttcaatgaaagtcagaatcaaatgacatcagcaaaatacataagcctattgaactttgaagtttgaacaatttcacaatatcagatatgaaaaataaatttaagtggttgaaacacatgacaaagtacttaaacagacaaaaaaatgagagtgtaaaaatcaaggtttgccatctcgataccggaccccgtaccggtaaaattctgcttaatgtcggtacgtggttcagtacggtacaataatgtcagtacgctccgagatagcatattagtacgtaaccaatacggtacggtatgggcggtacggggcggtatggggcgatacagtattccatggtaaaaactaaaaaacaaaacattacatcactcataatgcttagaaaattgaacatggacatgaaacagagttattgcttatcaggctactgcaatatatttaaaaaaatgtacttcatgtaccaagtgcatgattaactactatgagaaaggatataaatgattttcagagtctaagtttattttttcctctaacccacaattaaagtcacattaatcaactccgctacttgctccttaagtgtaataggatagaccatagcatgagaaaggtaagctattttccaaagactgattaatgattctgtagtatctcgctgaataagaccctatattttcgggacaaccgcatgggagaagaaactgagataaaaatatcaaaaaaaaggaaaactccccaagcaacttatgtggtgcaaccaataacaactcttcttccccatcttttcaggcatctatcattttctgcagactcacttttgatttcttggaatattgcatgtggagagtatgctcccccaacaattgttcaattattttcatggtgtcaaaacaagggaccagattaacgctactaaaaatgccaagagctaacatacaagatccgataaccaattggcaatctccactaaatcctcacctgcactctacctaatggcacctccaagaaacaccaacatcaaacataggaaaggaaaacaataatcatcttcatggtttgttgtaccaccccatactggccttgtaccaacatgctgtctcgtgccttaccgacactcagtatgtggtctcgcactgtaccaaaccatatatcgacactataataggatgatattggtatggaatctggtactgagatggcaaatcttgatcatctttttatctatcaaatgtttaaaagcattaggtaacaattggtcattcaaacaatttttctccatgtcttcactaagtaatgaccagtcaagttcaccaggcaatgtctacttaccagatattttagcaaaaaaggtcctacaaattcaatcttttaatactaatgtaagggtgattttttgctataaacagacagtacaagagtttaccaaacatatacggtagacagaattaactcaagagaaacaagatgcccaaatatttcaaatatcagcaatgaaaaaaggtcactgtagtcacctaaaccgcttttgttccccacaagtaattattgcataaggatccgatgtgccattcaaatttgcaccaactaggttcttggcagccaatagttccaactgaaataaggaacaaatacaaaccatcacaaccaaatcaaatcaatacatatgatctatatatgaatatagcaagaacatgtaaattaaatggataaaaggagtcatgatttgcgggctccagatatcaaaatctctttctcatccaagagattggtgttacacaacacgaaatacctttactaaatatgcagaagtggcttgagaatctcctttagattggctcatctacaaaataagtggagaactgcatgtcaaacaaatgaaaaaaaattatttcatgaaacagataatgagtaaagtaactttaaaaaaatacaaaaaccctttactttttcaaatatcaaaagcaatcaagcccagataaaagcctacatatctatgctcaaattaacataaaattgtaacaagaaaacgaggtataactatgaaaaaagacatgtacatctatataagcctttgactggttagcaagcagcgacgaacataaaacatgttcataatccagttcaagttatgacaggaagctaataaatccaataagtcaggaagcttaaactatagccacaggacagcaatgcatatgcccactcccttccacccaatgcccaataacacatgcatatatacacatataaatgtctagtttacataattacatatacatgggtacatacatgcatatacagagattgacagacagacaaacagacaaatatataggtcaagaaaatgaggtataaccatgaaacaagacatctatataagcctttgactggtaagcaagcagcaacaaatgtaaaacatgttcataatccggttcaacttatgacaggaagctaataaatccaataagtcaggaagcttaaactttagccacaggcaagcaatgcatatgcccactcccttccaccccatgccccatcacacatgcatacatgcacatatacatgtctagtttacataattacatatacatgggtacatacatacttgcatatacagaagtcgacagacagacaaacagacaaatatataggtcaatatataagagaactcctcatctattttttacaggttaaaaccatcatcaaaatcacattaagattataacaataccaacatcaactgctgttacaaagccctcatttaagccgttattatttcaaccatttttgtttctttttcttcccatcagctacctcaaacatgagttaacaaagtttaatatgactacttgattagtacagacaactgtttaactgtaacatgaacacatgatggtgacaacaccctaatgcactaaaaaatacaggattttgaggaccctgtatcagtgagtttatagggaatttgattccaaattttacaagtagcaaggtagaaaacaagcaattgcaatgttgcatacatgtcatgatgccatatgcttcacttgcgtctttttccactttttatttggatattatgcccatctacgtgtaaatacatttgctgaactaccaagcttccacagcatgtgaacactttgctgtataatattacaagcaagctaaaacatatagaaatgatcagtgaccatatagaaatagaataactagaaatcagtttaaacaccctaagtggaaacagattgtgaacgatagagcatcatggtcactgtcttgagcacttaactgttcttaacagttaacagacaatacgtcaggcagcaaagagatagcatttcctcattgcctggggagataacacaaaagagctattggcctccaataaaataggctagttatgtgtcaatctactggttgcctcaacactaaaatatctgcatctcctgagagctctgtatgtatccctctcttaagttggaacattgggtacaacgggtgtgttagatgacctttaaaatagtgactaggaaggagttcaagctcttcaaaactctaggctctagcatgccttctctcactctcatgagtttgacaaaagagaagaagggctgcgtataaagattaagaaaggattctgtccaatttcaagtgcaccagaaacaacccaggaaacatccagctatggaaccttactaacaacagtgttttaacaatttaaacacaatcttgcttgtccataatccaacaaacaaaaacacttcagcattgattttcatttattgtaacaccaatgcaatagtgaaacatagccatcttccttgaattcagcgcactaactaaatgaatatcatcaaaaagaaccatactgcaagagcactcagaaaatgctggtcaaatacgctgcagcttattatcttggattggatcattgtgtcagtcctaatcaaaattttggttatgcattgcccagatagatccctttgacatccttaattcaaggtgttgatagtatttaaaagtatagctggtagtatacacatatgcattatgtccaagtttgatgcataaaaggaaaagggttgcatcccaaattaatcacatagatcagggtattgctacttgcaggaacttactacaggtatcgtgcccagtccaacatttgctcgacaaaaacaatagtcccaaacaccaaactgattgactaaacaaatgtgctaaataatgactccctcatcaacaattgtcttgacggaaaataataaatataccaagaattttgtttcaattcccattaaccatctaatagagagaaaagggatgacactagttaagcggtagactagtgatcccaatcgtggtaaagcattgaatgaaaagagttgatcttcaaagccaagaattcgggtagggattctttccagtcatcacatcgctttgcttctatttctttacttgactgcctcagactctgcaagacctcgctcttcgaaaatgagttagaagtgagagtggatgtcaatagaaccatactttgccatgtcaataggagagagaaagaaagaggacagcaagaggaggccttgttatatatttcaggagagaaaaggaaaaggcatcacctttacaaatcaagtcaccttagatttgtctatcatccattatttctcacttcttaggctccatttttgggggagccagaaagtactttctagccctccaaaagcactttctagcaaatgctgggaagccattttagctttaacaaaattttcctagtgactaaaatgcccacgaacaaatcccacaattacacctctaattgttaactaacattagctatattatattattatatcatatcatatcatagtatattatcttatgttatattatattatatcaaatcatatgatattatattattatactataaatatattatattatattattacattatattataataataatacaataatgcattgctatattatatcatgtcatataaaatctacattatatcataaaaacatactataatattatatcacattatattatactgcaataatatattatattatattatattataataatattatgctttgtattccactatattttaataatattatcttatatcaaaatattaaatcacataatattacattataagaatattatgctatgtaataatatcataatatataacaacatataatattatattatattatactctcctataaaatactatgtaatattctttattgtcattttgtcataccaaaagcactttcacttttgccaccaaacacttgttacagttccatggcactttagagaggtaggtactaaatagcaaatagttttttgtaaaaattctacttcccaaaagctttacttccaaaagcttattaccaacagcaatcccaaatagtgcattagttgttcccaatattccaattttatttaatcctcttgatcttttccaatgttatatcagttgttctcttttttcttttaatttcacaattcacccaaaaagttatattattactcaagttcacaatattgatactggaccccctgctagtaccatgttggtatagtgtcaatacgcgagatacaagtgtgtaccaacacttggtatgtctcccctactgagcatcaattcgatacagatataatatggtatgcctgatacaggatggcaggcaccaatattgcaaagtgcaaaccttataattacgtatctttcttcatacaagtggtccgaaccaacatacaagattaagattttaaacaattacaatgatgtccagggtccacactaccctttcaatggaggatacagtgccaattgcaaagaatcacaaacaagcattttgaaactatattgcaattgattcatttcctttctagaaactatatgcgtgcgatatcacagtagaattgttcaatttacaccacactgtaattgacgagtgccgatcaatatcaccaatgctcatgctcatgtataacatgtttttccagtagcattgagcaaagcttacggagttgatgagaattcagatactatttgtaaaattatggcaactgtatcaagtcatataaccttttactttgtcatggtagtcagatgatgctaaagatttgtagaaatcccataatataatcaagaagaaaaaaattacatacaaaataaaccaaagcactagaaaaacctattccatctctttgtctccataattctaaacagttaagaagtcgaaacttccctttttatcttataagaaagcctcagaattttcaaccacgatcattgagcctcagcttgtaacgatgacatccttaaattcattggaaactaaattatctacccatcgaagaattgctgttttctcaaacaaacactcgactggaattccaaattaactgatcgataaattttcaaaagaaaaaacaatttcacacaactaaccttctccttctcgtcaagaagaggctctttcgcagccaggagctcatcgccaccagacgaccgatcgaccccaatccccgggccgccggaagagaagcgttcgaagaaggtgtagacggcgatcacgaagagcgccgccgcgacggtaacctcgatctcccaccacgaggggaaaagcaaaccgatcgagacgtctcccatggccaccgagagaaagccgacgcccgcggggctctagggtttcttttgggcggcttttagggttccttggtcggagagggtccatggtaggagagggaggaagaagagagcgcggccatcccgagagagagggaggggtcaaacgagttggttggagggagacggcaaagacggtgttattaattagggatcggaaacgaaaaaaaaaaaaagggaaattaaaggaaaagtagtgggttcccaaactgcccttgctattaatgaagggctctccagagtgccatcttttgccggactgggcttgttctcgctcgtcgttgcgttcgaggttagaatagaatcgctagtacatggacccaacgacgttaccaaggatgactctttcccatgtggcactaattcattctggaagatcccacgaccaactgcccccggtgaagcagaaattatggtgaaacgcggcaacggcaagctttcgtacaacggttgggccccaaaactttttcacgtgaatcaggatcctcctcactcgcgctccggcgttcaaagagccgacgttaagacgtctgctatcgaaaaaagaaaaccgttgttggtaccgaaaaagaaaaaagagaaaacaattgttaccaaaagaaaaattaaaaaaaaaaaaaactaaaaagtatctatcttggttttaacatgcacgtggttcacgaacggttttgctcattctatcacccatggtccctaaaaaataggcctaaaaagctcaataactgaaaaaattataccacacacgacaataaagctgagactttctatgactacaaaatcgaaacaaagtaattgatatgatgcaccattatacagtggtaggatataatttctcatgtttatgggatatactagatgtactagggatgcatgcaaggcaaacatcaataactttagtaaaaaaaggaatttattaatttatatagaaaaattaaaaagatttattagctgtgatctttaaaaaattgtaagtgtttttttttttttgtgtccatgcatagttgggtgattcttttgaaaaacaatattaagtggatcattctatgggacaagtcttgatagttgatctagtacgcatgtttaaatgaataactaaacatgatattaagttaataattaaacatattcataatttaagtatttttcatggataccttctccttttgtcaagatggaagggactcaaatcgaaaacactagtacctattttactaactttaccaactttgttatttagcttcctcaaattgatcaaaaatatatatgttgatgagataagcatgccatatcaatagtttcatggaatttgtcctataaaatgctccccaagtttttttcctaagcaaaataaaaattagatcaaaacaaaagttttataactatatatatagttatatatataattggatatcttttatgcatattgttatgcatatcttgtgatcagaacataagtttgttttgtgatttttttggtgaagtgtctttcgttccaataattcttatttttgtcccaacaatttattaaaaaaaaaataatgtatggtcttttcgaattcattgttggtgcatattgcttacacacatacatacatatacacacatacacatatatacatatgtatgtatatacgtacatacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaacaggggaccgacaagtctcctccttttgagttccgaccggcggtgcagccgacgtggggcgaccgtcggtaagaggggggcggcccaacgacaagaggagggccaaaccggtggtcggcggtgaccatcggcgcccaaacatccaacggaaccggaaatccccccttttctcaaagaaatccgacgactccggtcgtcggcgagcatgcataccggcatgaaaaagaaaagggagaagaaaggaagggaaggaggcttacctccgacgtcggcgagactttttcggtgagcaaattggacgggcacagatcgatcttccgcggtggttttccggcgattgccgccgactgggcttagaatcttcggtggaagggagagaggagggatctcctccttaaatagagtgagaggagagatcttttccaacttcgattgagagccggcgagaggaggaagaagactcccttcgggagttcttctcctctgttttttttttttttggctttggtgggttgagatttttactcgggtcgggccatcacagtggtgaagcaatttatttcaagctctcaacgaaacatttcccacaccagacaaatacgatattagcaatccatgtgaagtatgccatatacactgctattcatcatatagtgcccggtcatgcatgttctacaaacattcatgtggggggcgatagagactaaacccacagagaagtgttcaatcatagaaaacaaattagaaaggtcaaacttaaaaggctcctcagggcatggcaagaatattattctgcctgccaacctattattagggcaccacagatagttgtagaattcctgtttgagccatttgagttggtggagcgaaatccttgatcatgttatcacatctttagggtcttatggcttcatgaggatgctgctaccgccagccaagctgctagttgcaaagggaagatctcgaactagaagcctcagactttgagattgcatagactgcaacacctcaacacactcctgcaaatcagattcatcggccaaattgacccattcgttctcatcatccatatacttgagttggaatgtcccgctgcacaatttgaatctcttctcaatcacctgaatcaactgatggaaacccatggacaaggagaatctgaaccttacagtgtcctccttataagtagcctttacacggatcgcagacccgaagtcagtggccgacatattgttctttaagcttcttttaacagtggggcaacttgaagcactgccactggatgagtctgccatgctggaataagaaggatgactttgttctatgatctgttcgctagcatccatttgggtatgcatttcttccactattgccatcgagcttgagctttttgatctagtgctgcatttaaggctctccggaccgaagccatccttgctagaagcatcatggcagcatttctctttagcaaggctggatagccctccgccagaagtaaccttacatttgtcactcatgccaaaaggtggaatagaggctttatttgcttcatgatgatgaagttgtggttggcctgaattgccaatcttgtttctgccaaccaaacaagcctcttcttccaatatcccaccaaactgaactggtaaacatggacgcaatggttctgaggctgttgccgcttgtttttcaggcgatgagacttctgtcaaaagttttccagtagcattatcatattttaacatacctgcaactcctggtacagagtctaacatgttctggatctcactcagagaatggctggctttagttagcttgcgagatggccatcttaatatcccattccgcctgcatattctcttcagcgtagtttgacaaactgacaatatggaatattcaaaatatatcagccagtttctatttaatgagttgactaaaattaatacaaatcgaaaagttttatcgcatcgattgaaattagcctgaggctcaatacttcgcaaatttttcctttgtgtgtgttacatcttaacatcgaatttttctagaattacttcactaatatccatatcatctttaggtccacaatatttcttttctctgactcattaatccatatatgagtctcccctcctctcaccaaggccacatctgaccgggagacatcccaaccatctcaggtctttcagtgccgttcctaaatttcatttagctaactcatctgtaattccatctctcttaattctaccacatcctccataacatcatcattctgccattgtatcttaagatgacaggccaacttgatctttatctgtatgatatagttagagtcataagataggtgatgtcatcatgcaaaatttaaaggccttctaattggcgaagtctatactaacaataatagcacattagcctagctaatttgataatttttagttctattctgaggacctcatgatccttgtcgtggtcttggtaggatattacaccataagcaaagccagtaaacagaagaatgtatcgcatgctaagttccaacaagataaaagagacgaaaagaaaagctcaccaccaatgctctttgcagcatccttaagagtttcagaatagtactgttgaagaacacttagattaatattcttttccactgtactacgtttcttctttggatgtctaggtgagccagacttcatctgcattatacaagtaaattagtttatgagcatattaacagttgtcatttttcaaaatttccactgcaacttataaaatctaactcacaaagaaatgaccacctgaatgctacaaaaaaaaaaagaccgaattaaagatgcatgcttcctctttcaaggctgcaactacaaacaaattcatgacaacaacagagaccaaaacttaaataaccaaattgagcatcacaagcatgcaactaggaagctaaaatcattcaccgtgcaatctgagtttcctcaactttcgcaacatatgataattaatgttctctatcatgtatattcagcagcagttatggactttctgccataagatatatgcataaacagatactgacatatcataaaatttggaaaatctagagttcagtcatgttccttatacttgaacatggagaactccaagtagcaacaacgtttgctgttctagatttcatttggctagattacagttaccatcattttatgaagacaatacagttaccatcattttatgaagaaagcacccctcaagctggaacattgactcagataggaagagcttaatgtgctttgcagttattggcacagttaaggtcatgagagtttaagatgtttctatccttcctctagatgttctgttgattacaatctatagtatcgcataaagagtataattcacaaaatctgaacaacctgaagtagcaatttggttaatattatgtaggtgtaactttgtaagtttgcagctactctgatcactatatatcacaagctatagaacctatatgacaaccatgatgaattttcatagaataagtatttagaaacctgcatctcagcatcattaacaaagatgtagtatattcaagcctgctaaatggttatatgttcacttgtttcattactatattaactaaaataaaccgcatcctttttcagttatctttatgttacttggttagttttggaggatgtgttttttacttcctacattacacctcaaaaaaatcttcctattacttactacaatagggaacagaaagagtagttactgatgcaagggctacagtttatagccctaggtagctagaaccatattgtcaaatcttcaatttaatcaggattcttcctttcttctcttaaatattccctggtaacaacagaacttctcttcactttatagcagtactgtgtcatgaatattcacaattactttgcatgaattctaaaaccctccaagtcttttttttcctgctttttattggtatcaggacctccccatgtgcatgtggcaaggcacgtattataaagacaaacagttccgaaatgttgggcaatgatgacccatatagccaaagatgaatgatttagtttttgtttccaggattctacagcgtgtataatttcaaataattagtataatgattgtgtgattaagatcagcacctgacttggatgagcatctccttgtttaccagcttccatatcttgaaattcgaaaggtaacttggtcaagttacattcagtatcatcgtgcaagtgttgggagttttctgctgagacagatatggtttgtcttgttcctggtccctcattagtgacatcagttctgatcgcctcagtatctgaaactgttctcaagcttctgcagattctctgcaatgtaattgacatgttgttcaaaaggagctgctgctctacactccctttacagttgataggaaggaagaactctagtatgtaattgtcgtttcctgtatgggcgctccttaacctgattgcaacagcagcatgcaggccaaatttgcgagcatgatgtgcaagtgggtactggtgtacatcgtaacttttgatgtctgaagagaagacaggatgagttgattgaattgcttttccagcaatgccctgcccattttgaaggtggtgttcagaacatgcacgtagaaaaccctgcatttgttgatcattgacatagcaggccgactcctggatacagagcacgattttcctgtctgaaataaagtttgcctctgcagtatctcttgtacattcatccacacatcccttgttgctcaagggaacccatgtaagtgccaaaggtaacatgtgtgcatgacaaatggctctcaagacatccaatatctctgtgaatgcagacttctggcccattttaagactctgcagttttaaatcatgaaacatgcaaagaaacagtgttataaccaatatataaatcatttactggagggggaaaaccaccactctgccaccgcaaaattaacacaaacaagaaataatgtccattagcacctgctttcgagcacatattttgacacttcttaaattcacagcctgcaaatttagagggagcagaaattttagatatgacataactattccaaaatagcagaaacattaagtatttattggcattaaacctataattgttatatctatcacaaacaagaatcttcatgtattcattctacatgcttgtgtaactaggaacatgtaaataaatacattgacagacaaagatgtccatgcatatgcacgcaggcagtggctacatttatgatgagaagcaatgattgacaaatggaatcagcaagcagcccattcttaattgacaattatgagtaacttctgatgtatgcgattcagtaaaaccatgaacatgacttcgtttccatctacacgctaccaatcaaaacttggaaaaggtgaaattccatatgcaacagaagagaatcatctaaaaagtactcagaccatcatgatgtggaactacatgcacaacacaatgagaatgttatttgcagaaaataatacattgaaatgatacataagcataaacaagtacttgatggaaaataatgcagacctgcaaagctcggaaaatgctatccatctcagaatcaaaatcagatttctccttcaccgttacaagctcaaggactccacagcatgaacgttcattgagatcaaacattggtaccgcaagtaatccacggacctcataatcaagtgcatactccacccgcaagtactcttgccggtgataataggcaatgtttgaggtccattccggcattccagagacaaatacacggccaggaagcccagtgatggaccctggcgcctcttttgcagaaaaagtatatgacctcgaaacttctcggtacccagcaagaatccggtccagaagatagggctgctcatatgtacttaatatatacttatctccctgattcataggcatccaggcctgggcaagtatccctgcacctgaggattccttaaacaaagacagtgccttgagcaatctctcagcaagactaactcccatcatggatttgggtacaacagtgttgcgttcctcagcatcagagacattgaattgaagcccatttcttcctggcatatctatctggagagaattcaacaaaaatccaggttgcaggccagaattttgtggtgctgaatcatctctaaaacaagcatctacaccagctgaatttatcgaatcatcgcaaatcctaggcacagaatccctgcatgatgcttgtgaatttggcgaagccagaaaagtctcactaccagggttcagccgagctactgagtagatgaatggcgagagaaccgggtcagcaatcggtggactgcagagttcagtgaacgtattgatagccttctgcgctgagtcgctaaataggtccaccgacatcgggctcccactcccctcgaggaacggagaaaacccatccatttgagctgggaaaataacccaaaccagctcgttttcctctagctcacagtggatattccattctcttgctcgacaaattaaaccttgacataatacctccctccaaccgtaaaaaccagaccttttactgaagaagatgatttcctctatatttagtaccggaatctctccaagaagtgataaattctagccaaagatccaaactttcatacactactgagctttgacgaccaagaacaactagctcaaggtcgaattggatcctgaactttccctatcaaattggaaatctcagacaacgatgaactagctcgatccagtccggacccagcgaaaggcccaacttttcacggacttctctacttccaggaccaaaaaaaaggctcatagctctaaaacagatcctagaaaaaaataaatcgggaatccagaatccgccctcaccagatagatccagtctctgatccagggcgatattcccgaaatcccacgctgagatgcgtcctccgcgcctcgaggatttcgaagacacggcgtggaaatcggagaacctaggccaggaggaggaggaggaggaatctggacattttgtttgaacgtcttggacgagagctggagctcctcgtagccttcgtctccaagagtcgtccacttcctctacttccaagctctatctatttcaaaattttgcgaaaagcggaggcttgtgcttcttcgctgcgtctctcctttttgtggctgttgtaaacgacgcggggccggcgaaggcgggaggcgacaacctggcggcttgttttatgattttgcccccagcatagcataaaattacaggaaaaaaaaatgtgcttcccgtaatttttctttgttttttttttttcagattgttgttgtaaaaattaatttcaacatacatcatatggtttatacatttgtgacatccacatgtacatgccttggaacggtttacaaagtcatagaaattttcttgcttctgggttgcatgagatcacattgattaaaccagttttgcttgcttaatttttaggctcctattgatatatctagctgcaaataatgagttcgaaacatctctcatttgggattgaactggagatttccaatggccaatcaacagctatatgtgtctcgttgaaccattgatgattgaatggaatccatgacacatgcatgcatgcatgcagggttgtctctgccatgctcttgtactggatgttcccctatacatccactattgataaataaagatgcttgaaagtcttgcattgccttgtattgataggaaaaattaagagctgctgctcaatgatgaaaaaaagacaatccttattcaaataggtgatgatctagctaactacaccactcagtctagaaataagaagagctccgatttgccaaaggaaacaagatgttgttcaactaaaacggtcaagatgtaattcctcacatcaaatttttggattctctgcatttgtgtaccgacaatgactccgaatctcacctttggtgcctgtcagcactccaatgctccccattcggctcattgtgaaagcaaaataacgcctgaaatcttcgaaattatgagcaaactgatcagctatccgccttccatcctcagaggaagtgatctgctggtctattccaagcacgcccaagttccttagtactcgtttgtagtaggagttcgaaaatgtgtagctcttgccggatattggatttaggaagacggtcgggtcttggtgcatgtcatagcattttggctggcatttccccctcagctggcgagcgagagatcgagccatgctcggatcaggttttccggtgtgattgaagttatgaatccgatcatggatgtaatggcagtgagtcactcccatggtgtgagcacctacaaattaaaaggtacagaaactaaaatgaagtttttactagagagataagagttttttatatggtaatatgctgtcacctcctaaattaatcaagcaatacaagtaaggttgaggaatggcaatatacaaattaggttagttatccaaagaaaacttgtcattagcatccaaatgaggttattttaagattatttacatgcaaataagcttatttttgaacaactaactgcgctgaacatttcaagataagttgtttttttttcagaaggttgctttcagatacagtagatgagtagaacttatcaaagtataggaagagaaagatgttagagatcatgtatgttacctaaaagtgttccaaggtcaagcacatccagacctcgagattggaagtacgcaagggcttgatcccatgaaatagaaggaggtggtaggtctaccgattcgacggtggattgcacgccgtcgcgtcttcctgtaaatactgggtacttgggtgcaccagccttcaagcacaacaacattgccataacatcatgtcaatataaaaggtcaactaaaagagtgttgcaacttattaaaactcatgtctccaaccaattttttgattggtttactaatttagttctcttgataggcgagatttgttgaattgattaagttccttgttgaaatcggcggaacttgctgatctgacacaaaatacttgcttgagattacaatgatttgattaactttaaaaaagtaatcttttttcagtaaagagaaaaaaataaaagatgcaaagaaggattccggtcattaagtaaaaaaatctacaatagatcttctagagtttgatgcaaaaatgtctacagagttttttaagtgctcatctcccggccaccggtggttattgtaagccactcagcaatagagtgagaaacaatatgtgagcaaggcagtaaaagcttaaagttaaatcctgtatagcttgctgacatgttacacagtgacttgcttttctccaacagcagaggcatggatatcatagatggaacctgaaacactaaatatgggatttcatacacatctctctagcctatgaatcatgatttatagagttagcatatctctctagcaaatgagtcataatttatagacttagcacttgaagtcatgtctttaattacaagatataattcttttctagcagacaatgttaattgccggacaagctggccttgtcaggtcaaagccaacatatgtatcctttagagaggatgcaagtctaaggtctaacaagcattttcctggtcaaatcaatacagaaccatgtctcaagaagctgagccttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaagcttctcgtcttctttagcatcaacttcttcagatatgtgttctgaattttgaagatatttttagtcgcttattttgttatcattgagtcactcagaaagatttggcataatttgtttgctatttggaaccggcttgcttaagatatcaggttttttttttttggtaaaaaatatatcaggttcatcctggtgttctcgcttgattataagcacccacaaagagcatctggtgattctttttttttttttgggtgcaagtggctggaatatatatagtctccaactgcataatttctttattggaaaccccgtgatagatcctggagatgttgatgaccatggaagtaagacaagtggctgacacaccttgtgagccttatccatcaatcttatgttgactatggatgatgttataaactgtggaagttgatctccaccataattacactgtcatgcccatttagaattggggataagtgctgacagggaagaagtggctcagatgaccgtcagaaaaaagaaaggagcatctatagggggagaatacgatgaactgggggaagtgaagcactccctggttgtgttatatttgttctgcagcaaactggtgggagaagtgctttttggtttgtaacaatgacttcccggttgtgggttatgtttcttctggatgcgatgactcagctgagtataatatattggtcgtctggtcatggccgtgtcaaactatacctacaatgagccatgcttgaatcatgaattatgtcaagatgtgcatatgcctaaaccgaatcattgccttagcttggctatcaattttatttttgactgcaatatgtcttcagttagctgtaggagttttccgaggttgcggagttcctagaaaaaaaaaaaaaaaaaggtaccacgtgattatggggtgtgcaacaagtttgttctgatggaatgccatgtaacaaagttagctcacaggtgatgcgtgaaagagatatatatcaagatcttacctaaaaaaaaaagagatatatatcaggaaaacatttattaaaaaagataaaacggtaagaaatggtcatatatgagcaagggagtgagagggaagcgccgaaggcttagcagcaaaagttaacaggccatgtaccgagaacctcgcaaagaagtgtgcccacttgccaaaagggaagcgtacccagttaccgctagatcttaaaggtttggatggtacaatctcttgcctctttaggcgaaggacggggatttgattccaaaaaatgaccttggcccttgcttcaacctctaattatactaagctttggttgggtccaacatctagcgttggcctcccctcctcctcttcttcttcttctttttaattattattattttatgataattatagtattttatgataattatatcattttaatatgagtacaactcaaaaaattaaaaaataaaaagttttggagatcccatgggcaagtcttgtcttattgtcaggcccggtcttcgacatgcttggtaatatatggtgtaatctgtcgcactatttgcctctcgaaagatatttcgaatatcttggatttagttgataattaggtataatttctctctatgaaaattttttctgctggtaactcttgtttggcataaataatgtctatccaaattgcatgaagctcagttctggagacaaaaggctcaaaaaaaatgtgagcctcttattataaacaatctgatatccagattctgaatgacatagtcaacaccatctttaccatcttttagattactgttgccgttgaaaatcagtcgaggtcggagagaggatggctgagcctcacgcagggttgctggcattggagtaacctacaaaataagtctaaaccggaggttgtagtttcgacgaggatcctccgatgcttaaattagattcaaaaaataataaagcagcaatgagctctctgagagggattgattagtttacataatctttggggctccggtgatttatatagaaagctgtcaaacagctaattatatagctgtgagattgtacgatcctaaaattgcggggccattggacatatcattgtggacgagataatccaggtttcaatcgcttttgcaaaattaggggagtcagttacgcctgagttgatccactcgggatggacagctcggctccggttggtggctatggtggcggtttggcaatttgaagtaatctttaacatcacgtcaatccgaacattcatagcaatcatcaatccgagacttctacagtaactatcgtgataattatcatctaaattaatctttataaatttaaaaaagagtttttaaaaaataaaaaaaatttgataggaacagcatgaaaatcctaagaatccgaaacgtcaagagacaggccaaaaatatcggagcatccggtgcacagatacaatcttaattttgaagaccaaactatttcggaaaatccagatctaatggataacatattgcatcttatctatctctcagatatagatcgacgcctcgactatacttcaagggatcgtacgtagaaaggggaccgctactcatcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggatcatctcggagaatattaaaatcatttctgtttgcgacgtcccttatggagaatgcttttcattgagtagtttcacaaatgctgctaagatgtctgagactataatttctttttgctcatttcatgagacttatcttgcaaatcctttagcctagccacagtgtttggtgaaacttccatcttagttagatttgatctgctgctatgacaccaagttatcaagtcaatgatagatctttgtgtactatatgacagacacacctatagaaaagatagtgtagaagtttagtggaaggaaagtaaagtctggaaatcagttgattgtgtgtattaatcaatcttaccatacaatgatgaaaaaattgttttcaaagataacttccattgtgtgtgtgtgtgtatgtgcgcgcgcacacgcagacatacatgcatgcatgcatgcatgaatcaggtcgaccagatttggacttagatccggtcaggtcaaaactctataataagggtttcacattaatgatccaagctattgaatgtgatccccacctcaaaattgcttacacataaaaatcatatgatttggcgacctttagtctatgcatcaagtagtcaaaaattggatagtctaaataaaattgaattagatgtgttttttgatcatttgatgcataggttaggagtcttcaaatcatatgatttttagtaagtagttttgaggtagtagatcatatccaacagcttggatcatcgatgtagagcttccattatctagttttgatctgatcggattttggacttctccattgtctagttttgatctaaccagatttgagtccaaatccggtcgaccttacccaagtctgcccctacgtatatatatccaatttctcaaagtgaacaattgcctcattatgcagtatcacatgaaaacccaaatagtcaaaattaaagctaattttaagtaagtcctagaaggctagaagtgtaggactcctcaaaagaaaccttaatatgaaataaaaaaagagaccaaaatgtaggagtcctagattcactgttacaacactttgagaatctaggaagtaaagatggggaaggaaacagagggaaaggggtgaacaaattgaaagaaaccacaaagagagggagagagcactgacatgggatgatgtgagctgaggggctggagttggctggggttgggcagacaacgttaaaggttggcagaggggaaaccagaagggaagggcataagcagcagaggccctaagagccttgcatctaaacaatgagaaaaaaagatttagggttagggctttgaaatgggctgctagcacatgcagtgcacatggctcattaaagaacattggatgaattgctatgatctcatcaacccagaagttttttatgcaaaatttaatcttcaatatgttgtttacatgttattttttgttaagaacctatttaccaaaaaaatgtatatttgatctctttcttcaatggcctggtttctagtccttggcttttgaatgaaacaagaattggtttgtttgcatgaaacaagcgtaagtatgtatgtaatgaacataaaggtacataaaacagggcactagtgtttactaagtacacactagggactaaaagttacaaggaacatggttgggcttgacatgattaggtgatttacagtgtgcccatgtactgttcccattttttggtccctttttagctggagtgctcatatcctaagaattgagtataagttggattcgacttctagagctgaacccaacagtcaaacctgaaccttatgcaacatagcagcccacatatctttgctttttatttgcatgatcatagttccagtttgctattatcttagtttcacttgtctcaagctttattaaaaaaaaaaattttgcatcccctcttcataatttgattaattagaaattcatgtttagtttattttatagataagaagttccttaagtagaaacttcaatttaatccaatcaatattgtctccatgaattactatcagatttttatgccttgaggaaggatgttgaagctacagcagaacgtgttgacgagattagagcttctgctggcttggaacggttagaagaagatcttgctgtattggagaagaaggctgcagatagttctttatgggacaatccatctaaagcacaggaaatacttcttgccttgactgatgtcaaagagaaaatcaagctgcttactgatttcaaaacacaggttccaagctcgactccttagtgcttgtttcagcatttatgacagtgtcatatcatgaaagatcattcatgtttcatctgtctttaaattatgcaagatcatcagaatctctcgacaattgtgtttacaaggcaatttaaagtaccctgttcatatttagatccatttgtcattctcctcaatatttcataatgcattcttttgacatctatcaagcatattgcagcttactttattatattcttaaatagttctctaggctatgaagcatggaaatgaatacatgctgtggatgcagcatgatatagatacattgatgtagcaaatgttgggaaaaggatatgatacagctattaaaatccaaataaatattatatttattgcatttatttttcaaatacgtagcccatatttcattcaaaaatatcaaatattcacaaatttcatcatttaattatcatcaattctagagatcaatatccatgtgacacacaatattgtcagcttcaaagattctaaactaactatccattattgaaaggccaaatttcatcaaaagaaagaaagaaaatgacatttcatcccctaagctatccaaaaagtatctgggcatactcagagccttcttctaattttaaagatacctaaagtatgtctgtgaaatgcgtcctagccatgtccaacaattgtaaatatccaatatgtatagctatgagcacagcctgcaattagtattcagcttattgttctttaggagtgtgcagttttaaagatggagttttatcatcaaataattagagcgataggtaataggatgattgctatatatgcaataacagctcaggggttggtggaatcatgaaaaataactgcagccgtgtgcaaatagcaatgatggtgcacaaagttgggaaagtgaggatgaagttgcaaagttgtcagaaggaagtttccacataagaaaattgaatctgcttgaactgttttatcatataccataatctgtgtgcttgctaaagttgtcgagttaaaaaccacttcccccaccaagccccagaaaaggggaaaaatgaaaggaataggaaatctgtggtggttacacgagaattagaggagttaaaagtttacaaggcattcaacttgttaaaaataacatttggaggggaattaattaactattacttatgtaagaagttgttgaaatggataaagaggactaatttcagatgcatgatacaaatgaaagagaccaatgttttgcctttgatgcttttgtttcctgtaacttgatgcaggttgaagaagctgaaacaatagtgaatctgactgaggagttggaatccatagatactagtctacttgaagaggcctctaagatcattcgagaattaagcaaggcactggatcggtttgagcttacagagcttctttctgggccttatgacaaggaaggggctgtagttactataacggctggtgctgggggtactgatgcacaggtattcagttaatccattccttgcattttgtttgataaagtttatttaccaccataattcaaaagctactgactcagccaacaacatgcgcaacacccccccgccccacggctctctctctctccctctctccccccattttttggggccatatcagactgacattttataggcattatgctgtaagtatacaactgatggcatggagggtgagccacctgccttaccatatgcaccatttgctgtaaagtagaacccatcttcactagctaatctgagaaccattttcttttctatgtacatacatgatcataatcctattaacttgagagattttatcaacgatgtctagtaatctcacaggcaaggtttaatataattataacctgtaatataattataacctgtgcaaaatgctagacaatatctcaacctgatgaaactcattatcttgcatgcacttgcaagcttgatacagaagttcagtctccaacctaatggggttatcatagggacgtggttgagcccaagcaaatcacaggagagcctctttcatttatcacaaaaactgaacccccagcaatgcctgttatgtctggttgtgtgcatgtatcctgttacttgctagcagagactatcatgtgttctgaaggtttttggcactcctgttattttgttctttaaatatctgggaaggcatttttcatagtttctgtgtcatactggattaaagcttctgcttacaacacaaagctaatatcttaaacccatatttttatccattttcatgcacacagtcataaactacaaatgcatagagaagaaattctgaggctgtgagcagccaggagacaagatttaccaatccatttgattgttctttacaattgtagctctgaaattaggcagctcaatttttttggccctctagggcaatgtaaagtcaatgtagcttacactttaaaaagcttatttaaaaagaggaagaatatccatcatttcagaagttgcacaggccatgccattcagtacaaggtcaccttgagaggatataccctaaattatcagtaatagaagtgatagtatgacttctatcatgcgacttcaatatatctattttcagatacatcattgttatatttcactctaaaagctagatgggatattttgtgttcacaataatattgtaagactctttgctttatcttcagtgcaggattgggctgagatgctacttcggatgtatgtgagatggggggagaagcagcgttataagataaaagtggttgagaaatctatgggtgaggaagcgggaattaaagcagctacaattgaatttgaagggcgttttgcttatgggtatctatcaggggaaaaaggaactcaccgtattgttcgtcagtctccattcaatgccaaaggtcttcgccaggtaacctaactgctgtaccggccagctgatttgtccttatattagtcttttcatgtcttcaagcaatgggatatgatgagattgatttggagatcaacataagaatctccatctaccaaaataacgttcaactccctatactcgagtagccgttcgcagctccttcaagagccccttcagcctcccattcataattgagactgttatggtgaatctggccgatataatatcctcttgattgtggatgagatagcctgtgtctactcacccaacaatctgaataagaactccatcaatgattaattattggggtagttgagtatggggactcatacaaaaaagatgttataggaggtggagctcaacaggcttgaaatgccccagttgctcagtcaaactctgttacattccttagttttctttcttaatacacccgaagtattctagcatcaaaaattgccagatttgcaatgaatgccaaaaaattcatatgaccttcaaaggccttccatatgaaccaggtggtacttaatgaaccaagcatggaaggctttttccaaggtccaccaaacaaaggaggtagctgagaaagggaactgaggttgaggagactgcaagtagtggaagatgttaaacttagtattttcctgaatagcctttcagcatgcttgggaatggttgtgaaggaaacgaggtgttctttactttcaaaattttgcaagcacatctacatctatcttgggagacatttaacctttgtggttcaaataggcagttgtggtagcctcgagtaatagactttcttaagaactaagaagtaaattaaatagtttggtattgaatttattacttatttccatgtaatgtgactctttggacctgttggctactgaaggtcttatgtgaatggacatcgtttgcttccttatagtgttacaatgccatattgcgctttctaatatgcttcttattaagaagttgaagaaacatgctatctaatatgcatttcaaattttgatttgatttttctccttaatagattttcaagtgtgattccaatttggcaagacaattgatgtctatcatgtcaagtctaaaggatgaacttcattaatacttgcagacaagcttcgcaggtgttgaagtcatgccccttcttcctgaagaatcattggatattgaaatacctgaagaagacctggaaataacctattcaagggctgggggaaagggaggccagaatgtgaacaaggtggaaacagctgttcggattgttcacatccccactggtgtcacagttcgttgcacaggtttgttttacactgaagtttagatggcagtgcattctttttctttaattgttaagtgaaagacattcatcattgaactcaataattgatgaaagatttgcatgaaatgaaaacggagacaccatgcattttttaaaagagaatctcctttttgtgtttagttgactccataaaacaaacaatatattttgttttatatataaattaaggttttaaagaaggtaaatgtcgagggtcccaacttgctgaatggatagggtcttgtgttggaacaactgaacaagagacctaggttcaaccctaccctcgtgccggtatttggctggtcttccaaccattcctagtccttgaaacaaaagagtaaatgtggacaagagtgcagcaacaagctttccctctatcatgagaaaaaaaaaaatgctccagagagtccaacctattggtataaaatccttccgataccaccaacttaaaaaggttcagccaccacactagtctgtgcataaagcataaagaaaaaaaagcctgacatagaaagtccaaaagttggaatactgttttgtaccgtcttccttgcctctcaaaacccttgtggagtatggtttctgtatatgcaccatcttttgcaggtcatttaagttttcacgtacggtttttttttcttgaaggaataagaaggatatctccatatatatgtgtaatgttttgccttccttcgttaaagagatgcatcaaaacgtataatatctatcaacaataagtttcttgcttgcacacacgcacaaaagaagaaggagaagaagaaagaaagaatccataattttcaccttgtatacattcagaaagcacaattcagtaccaagaaatgtgttagcaatatttggttatcaaccaaaaagtggattagcttctcaaatttacaacaggactttcagaaatagcgctgatatcatgtgatttaggtaaagctaattcatactaagatgggacttatcttgctgcataatttaacaactggaaaacataagaaaaaaataaaaagaataactgatgccatgtgattttcctaacatttggttgtcctccctgctcaaaattcagaggaaagaactcagctggctaacaagatcaaggctcttagccgtttgaaagctaaacttctcgtcatagcagaggagcaacgagcctctgaaattaaacaaatacggggggatgcagtgaaggctgagtggggtcagcagatacgcaactatgtcttccacccatacaagcttgtgaaggatgttcgaacggggtgtggaacatcggatgtcacttctgtgatggatggagacttggaagcatttatcaaagcttatctcaaatacaaatatactagtagcatgggtgaagggaacaccaaatgataagattgttcactgactcctgtcttttttcaacctgtttatttaagttttatccttcagtatgtatatgcggagtctccaattttactgccaaatcattactacatttctcacccaatttttatgttatcatagttatgcttgtggaattttaatctaggtatttatcatcaggtgtcatgttctctacaaagaagacaagatttacctgcccctaaaagtagcaacttagtcttcatcacttcatggtaagctccactctggttagaaatttctcggtatagaaattggcataattttgaacagttgtgtcaggttgaaagccagttgtgaacctgatcaaaattcaaaggattgccttgaatcttgaagccagcaccttatgagtgcgataaatgctgttggcttgttgatcggttctcatgctactcttttcataacatttctcacgatcaagtgtcaagagtagtatttcaagcacgagaatagcattagtttttttttttggtagtgagaatagcattagtttaatagtgtgtatctagcctggtctaaaacatggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacgaaattcgtcatggagttggaatcttctagccggagcggtcggtgaatggagagatcgccaccatgatagaggtccggattgctgatccgaatacaggtcgccgcacacgtcgattccgctaagcatggctcgccgccgggggcgtggtgaaggaaaaggtagaggtggcggcggccggcgggagaagatagagatgggagtttcggcaggtccggaagcaagatcggcatagaggagagcgtgcgaatgggcgatgtggtagaggagacgggcgcggagagagtaggagaggaagaaaaattttttttaaataataaaaaaatattatatatataataaataaaataaaataaaataaaataaaataataataataacaaccgagaaaataacgtcctactccgcaacgccgcacttgttcaggtaaccgtcgagccctctgcttcattcttattttaacttttcctaatagtgcttcggggcccaagcatgttaccaaacccatggagagccccgtgccatacggcaccggaggagcatcggtgcgattcattgggaattacggaactactcgtaacataacacgtggcggtagaaggttgctcgaagctaagtgtggaagacgtgcttggcatcacttttattttctatttttaataataaaccccataaacgaaaataaaaaacatattagatactattattttatttttaaagtataaaaggtaaaataatattctaaaataaaaaattaaagctttttaattttacgaccgctacaatcagtaatttcatgattctaaaagatgtaaaaaatgaaaatgatgcctaaacgacggtctaaatttttaatcttttatttatttttgtagcagatggagacttctggctttttctttaatgaaactggagagtatgagagagattcagagtgccagaattcgtttgtctgtgccaagtctgggctggcagctccgttcaccatcgctgctttaatagagagagaggagaagaggagaaagagaggggggagagagagagagaggagggggtgggtctggaagtcttctgtggtcgcttttatggattcgaggacgtgatctcggttgcagtgtaaacggtggagagtggagaggggagggtggtagggagcggggcggttatcccagattcggtcgtatcacgggaataagggttttaaatttactcccgctctattctcggctcgtgccccgccgaattgggattctacgggggtggttttccgtcgctgtctcttctggcgagccgatttatgacggagaaagggaaagatcaagcgcttttcggtctcgatatcgggagaggagggtccttttcgtttcgttccggctccgggtattggggattgggagtttccactggagagcgcaaaaaggttggcgcttttgatgattttgtgccgtttttcttcgttttggatctgtaaggagatttcttttggtacaatatctgtaaagagattgaaagagcggttttaaatctcttcttttagttgattttttgatgtggaattgctgaacagtctgttattcatctttgtgatctctgtagcttgaaaaagatcttttcttttccttctctgtgatctgattgagttcggcaaaaaattgtgaaatttgttcaaaagatgggatttttgcatccgggattttaggaaaacgtgctcttttattaaaccgcaactttgcttcgtttctgatggtatgatccggtgcatcagatcgaaaagaccgtcatttactgtgaggaatgtctctggatttccaattaaataatttccttccgggcttctagaaccaaatcttttcttctcacatctgtgattcagtcaaacccctgaagaaaaattttcccttctatccatcgagtgattgcatttttatcatcgtcgatcgcctcaatgtcgaagtctttgttgtcctcacccgattctctgttgtctatctaactctatgattgctttccttgtcttctcttttttttgatcttcatatatcctcacatggtttttactgggaactgtgttattctttatgttctgtaaacaatagtggtcccttcattgtctcaatctgatctatttggaccgagtttgctttcaaggcaattctctattccttgttttttaagtgaggaatggacctattccctaaattatagctgctaactgctaaacttaaaagcgaattttttctggtacgggcccctacaagaaatatctttcccttgaataccttataagcttgtaccttgtatccagtagaagccagcatcatattcattcggttcgaattagtcagaaaattcttggctttatatcttgtttattgcatggtaaagtttttattttgcagtttattatatttttgatttgcaatggttctcgcagggactatttctgatagatttgagggtctctgtgtgtcactattttataggccagaaaagagaaccctctaaagcttgcgttttctgtctagtttttttaaagaatgtttctatcttaaattctctgatgattcgatggtttatattctctttgaaggtgaaatctctatgtaccaatcgactcatacctaaggctccttattttcaattctagattttgccgatcatcaacattctattacaatttgtgacagatcctgcagtccaaaattttcatatttttttctgtattggttatacatcaatagttggaatctatatagtgacacatggttttatcacaatcttttgttgatttctgttatataatagatttgatctattctgagtcaacatcttttttattctattctacctgagtttgctttcaagccaattctccttccttactctttaagtcatggatggattctatagttctatgtcccaaattattgaatgaaaacccaagaaattgagatgtaagtttctttcgtatccgtccctctgagaatttcatttcttcagaatagacaatgtttttagcttattgaaagtcactatctttgctctacccgagttttccaagtttctttcttgtcagctgcatggaactatctgattaaaaaactaaccatcacatttatttctcaagagggttttgctgtttttgcattttattctagttttcaaagatcctgggaacgatgcaatgaatttagttcaaacattaggtttcctattttatttttttagagcatctgaagtcttaaactgaacaaatggtttaatgtgataaattttttgaacctctgaattgatctggaatctgcattctcaaagctcaaaataattgtttgcttgtctcgatttctctgttaagtagttttattattagttgtggtagatgatgtgattcaggtagttcattgccttttggatatagatttcatctaatgcttaaaaatggtccatcagatcgctgttgctgagtattggcatcattaaacaattcatcgttaccacctgcaggttcattgaattccttccaaatgaaatgcattctaatatcaatttatttttttcttaaatgtttccagtgtaatgcactttaaagacagcaccaaatggcttcactggtccctggggtcctccttaagctcttccagcacatgaatacagatgtcaaggttgccggtgaacaccgctcgtctctccttcaagttgtcagcattgttccagcccttgctggcagtgacctcttctcaaaccgaggcttctaccttaaggtctctgattcttcccatgctacctatgtatccctacctgatgagcatgatgaccttatcttaagtgataagatacaattgggacagttcatttatgttgaccgccttgaagcagcctcccctgtacccatccttaggggtgtaaggccagtccctggccgccatccttgtgtaggacaccctgaggatattgtggccaccagttccctgggtttccttggtactgaaaaacctcggctgtctaatggctcaaaggatgatgctaaactgtcttcagaaaaagagaagaacaaattggggaaacagaatggaactattagaactgaggaggttgaaaaggaaaaggcgctgctcagtaagtcaagctctgcactctcgaaacaagcagcgaatggcaaattggagacaaaggaagctatgggtgtgagatcaagatcaatgaactcaaggtcaataccttcatccccgacaagtgtttattcattgcctgcatcatttgagaagttctccaatgatcttaaacagcaagcaaaaattaaagggctagaaaagccagcatcttcacagttggttttgttggagaggacagcatccattttaaaggttaccacagctggcaggaaggcagctgctggaaattctactcggaatttggtgccaggcattgaatcaagtcccagggctttgagaaggagctgggaaggaagtatggagacgaaagggagggttcattctaactcaaaggcaggcaaacttgagacaaaatctgagactcgaagtgcttctgtgagttaattgagactctggattcattctcttgcatataaattttgaatcctctttctgcatcttgaagatgggtaaagctagcaagcttcttttgtttttttggtcttttggatcttcaaattatgatgtaagtttatttagataatataatgaactaaattgctagttaaatgattgatgttgatgatatctggattgcgtcaaatgactttggcttatgttgatcatgttagataaaattctgaaacagcaatttggtggattcttgtcctttttgtttaacttgtctttctatggatattacaggagttgttgaattttgaacaatcatgtcagatatgtttctaactaataatttggttgagattctctttgatttctgcaaaagtaccaaaacatgcctactttttttcttctttttatttttatgtatgcttgtatcctggtggttggttatgtttctgcttattgatgtgtcacttaatcagcaaagtgtgcacggaaaaaaaaaaaatggtttcctctttcacatgctttacataatgcaggatttctgggtttaaaataagtaacatagcctggccttatggatgataatttatggagtttgataattataatcattctttttggtccattatcattatgctaaattattactgtgttttttattgaaggtttcatttgcatggattcctctttcattattgttagataaaactaaaatatgaaaattcaagttgctccatggtgcttgataatccatataattggaacatcttattctttatttattcacttattcaaacttgcaggttcctcgaataaaaactccatcaaatgagaagtctttatgtaaagaggataataacgttcaaactcctgtgaagaagggaactgcaaatgcagcttcagatgattcggataggtcaaataaacaacgggcttctatcataaagaagacacaagaggctactaacaatcttaatctcgctagcttagtcaagtttgtctctaatagcaaaagatggacagatggtagtgtttcatgggcatcacttccatcatctcttgcaaaactcggaaaggtatgctatgtaatatcatgtaacatgaaaatttcagagttcttattagaataggtgggttaaaattgttgcacatcagttttttgctcatacatgaacattatgtatcttctatttttagcttataactatcatcatagcacatatataacaaccatctcatgaggtcttgttttttgttattaccatcttatggtaaaccagcctggtcggtatagctatatggccttctggtaaaccaccttattgtgtatgtattagacttttgcacactgatttcttacttcactggtttagtgattcatttgttctgatgtttatgttttatttaggaggttttgaagtatagggatgctgcacaagtagctgctattcaggctttgcaagaagcctctgctgcagagagcttgattagatgcttaaggtaattacctgtatttggtaatttgcagcacttctccacttgacaagagctgaaggcattacacttcaagttattttcatttatacttctgcatttaattcctatccacatttttcttttatcctaaacgtgaattcatttgagcttcttcctgttctactatagaagcgttgatatgaatttttctattatgctttgctatcttgaagcaatctgctccatccatgataagtctaatgtaacataacagtcttgcacttaaccatatgcccacttattttgtaagcctacttagatcttgctgtctaacgaacaaattctcctgccactatgaagttttgatagttgatttttttcagtattttatgatctattctattaatttgagatattgaggctctgtgagacagatttgcaggtgcttttgaagatggtccagaaacgagttttatctcctcatagtatgtttgatcttattagtgtagttgctagaactggttgtttgagtgcatattgacactggttaatatattcaaacaatttggtgtgtggatctgcttaatttcattattatgatcaaatttttgaaaaataaactggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccaatttctgaaagaggtaccatcactctgagcttgacaaagagtatttatttgcaaatttgtagactttgtaaaggatggcctgtgagaaaatggatttctcatctttatgtgaaggcagtatggaaactgaatatagtttgatccttgagattatcttggagaataaaatctgtgtacggtttctttcttttccattgtttaactcctacaatgttggctcattttgcaagtgaaatatgtcatttagaatggtaaatatttgtctatcatctcctatttcacttgtgaaccacatatactccaaaagaacggcattagtagctaccactaatctttaatgtttgcaactttgcagctcttcaattgctaaaaattatcgacaaagtttacatacccacagttgtcaaatgtcttgcacttgataaaatgccatttgaaactttgctgtggtctttgtaatttttttcttttcttttcttttttccctcccctttttgttcctcacacactgacgaacacatgtaggcactgataaattctgaactgaaactgttgcttatagggtgcatttgcttgcagcatgtacgcagaagtaacgtccaccgcgaaggaggataacccccagccggcggtggagcagttcctagccctccacgcctccctctcccgcgcctccctcgtcaccgactccctcgccaagaatgcggtaacctcaccggaccaggccccggcgggtaaccccattccagaggaatccctcaagatctgcgccgacaagcgccggcgcgccaacacctgggtccacgccgccctcgccaccgacctctcccccttctccctctaccaccacaagccccaccttccgccgctctccgccgccgccgccgcctccacctcgttggcggtggtcctcgacggcccttccaaaaccacggcagcttcctccaaggccaaatctcgggcgcctccgcctgcagtgcctgtgagttctggatcggggaagccgtcgccggctacgacctccaatgggaaggcgcggggaacggcggccccgcggtcaccgccaccggagtgggctcgcggtggagggctggaggagggggcggagctggcgcgggtgctgagtgaggaggggagggggtggttcctggggttcgtggagaggtttctggatgcggacgtggcggccccagggccgtgggatcgggagcaggtggccgggatgctgtcacagctgaagaaggtgaacgattggttggacaggatcgggcggcggagggaagggcaggcggcggaggcggaggacggaggcggcgaagggggaggcgtgccggaggagacgatcgaacgtctgaggaagaagatatacgagtatcttctcgcccacgtggagtccgccgccgtcgctctcggcggcgggagctcggccgcggcggtaggaggcggagggcggcccggccggaagggatgatcgaatctgttgcgcgaatctcgatgcaagttaaagtaagtgttccccgccgttggattcgtggcagcgtgacgattaccggggctagtttacgtggcatcctgtgatttttctgttttcattgttggtattatgggagcaggctaatttgaggagtgcgtgtacagattggatttctgtgagggtgctggttgtgttctccaaaagggcgtatgggagatgagggataagaaagggagattctggtgtgtcttttttttttttttgggaaaaaaaatttgaaagaaaaaaaaaagacacaaaaggaggaattgggggcagcttttgatacttgttaatttttttattcttatttttttgccttaattattgtatgaaattgtatttatatgtggtgaatagttgaagagaggtgcactgttttgcttagtttctgggtttttaatttttaaaagtttgtaaatgtttctgagctttaaaggcaaagacataacaattatgtcatttttttttactatctgtcaaatttaatatcaaactcatatattgtaaaacattctgtgattattttgcttgctttgtgtgtgtatgtgtgtgtattataagttaagggtgagattgaacctagataactagtgatttcaacaagactacagctgacctagctagcacatgtcgaattagatgatatgttatattagaatttcaatggagtcgcaagtgatttcaattatttcaaactaggttgacatcgttagcaaatcaaaaataaattctgcatactcttctctcatatcaaaactattaattcttattccccatccatggtacgtgctaattaccctcgaatgcttcacatctcgtgacctgagttttgatctgtgagttgttgcaccctttcttccaaactgaagaagctatggggtggaaatttcacattcccttgtctgcatcagattgggtattctatcgagtgggcttccctccatttctctagccctttcaaaaagacaaaaactagaacatgatttgttttgtgcgaaacgtctaccaagcgatatgtgcgatagatctgatgaacccgttgttcaacgaagcatcctttgaagtcagtcaatgccctttttttttggttaagaagtcagtcaattctttgacctggggtcgtagaacaagacctgtactgtatgtccacttcttgtgaaagcaccctcgcaaacatttgactccccattggagaatccaaagttggtcctctgaactcccatggatttttgtcgaaactattacacgtaattttgtgcacgtgtcaggtaatggttggtccatgaaagggtcgtggaagcattttgggagctgattcgtcgaaccggagccgattttggtgtcatccagcgagagaggatgtgggttaagaggagtggacgcagcccggcgttttaagtctacatccacggagactgggcaagtcgtccatggatggtgggtcccggagtcgccggtgactaatatttccacggttggataccaaagcgcccatctgttctccaagaaactaccgaaatatcctgcaaactagaatttgcatgtgccaggcacgtgacgtaaaaattgacatcattttcccattcgggggaatccgaatctaaacactgccatgtgctatactttttctctcttccctgttttagtttactaaagaccgatgatggtgaattaaatcaaggtaaggatggcaatcaaactcatgtcattggtttctaattcctagattccagtaattttagcaacctcacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagcgcttcgatggtatctaccaactcctcacatttttttcccaatttatacctatttttgcatgatattaagctggtttcttgatgcatttatcgctgtttttcttcgcagcaattgatctttccatgatataaaacattcagttcaagaaaaagtattaccatggagtttttctaactattctttctttaatcttcatgatgagggactacgtctaaattttcctttttctttttttaaagaatcgttaagcaactgctggtttctaatttggcccgatctttaggtttctgatgtttacttctagagtgatgcttagcttagttccaaatgaggcatttaatgtttcaaactttcctggttaagtaatggcttttatttccagctggagttgtttccaaaattgttttgtcattaggtaccgtgttagtcagttcatttacaaggggggatcagatgagtctaaagtggtaaaaaaagttattttaggtttttttttcttttttcttccttccttctgttgttgtttgtaaaataggttacgatagatcggtttaatccattctgcagcaaacactcgcagtaaattatgcactatcaatgcatgaatgattttgcacaatccaaaaccaacattaggttgagaaaaagaggatggttattgtcaggttgacaaccagttcttgactaggaaatcctagttttaacgctaatccttattcgcttgtaagcatattctagtggaaactaagtttaggagctgatgactctgaactgatcagttatttggtgcaagatttgggctacaagaatttagatgagatgcactgaaaaaggtcacaaactgcactataattgtatcaggttgttccatatataaagttgtagctgattagtgattgcatacgtgtttgatgattgcacagtgtttcttttatcttctttcctatttttgacatcacttcataatgacttatatcatgtatatacatctaatttgattggctaacatagccttgttgtctttgtatgtggttactgaaaagatggttgggggagacgttgggtaaaatcagactggaagaagagtgaaggaaaagctggttcctttaaacacacggcgggacaatgggctggagatccagatgacaaaggcatgtttttcttttttcttttcttttttttttgtcttttttgtgtaccttgaactttaactctcaactcgttgcttctattatggtgaggatcttaacaagcacttttgagttctatacaccagagaaggtatcaaataagtgttgtaatgatgagcagaagctgattttgaatgcacttgctagtttttcctcagtaatttcatttttgctctgagcatatgcattttctgctggtggtcaattcaggtatacagacatccatggatgccagacactttgcgatatccgcaaagatcccagagttcagtaataagaacagaacattggtggtccaatattctataaaatttgagcaggacattgaatgtggtggtggctacattaagcttttctctggttatgtaaatcagaagaaatttggcggtgatactccatacaggttagctgcataatttcttcaaatgtgtgatatatgttttactccttttgattttccaacattttgaaatatctttagctactatttacttatattttctttggatcataatttcagtcctccgcagacttttgtgctatcattgaatgaccataaaccctgtgattagattttgtaccgttgccaactgaaatttttgatgcattaaaggatgcttgccctgtaggactattgttgtctcatttgggagttcacattatttaggttcattaaaactaagtatatggagaaagaatgtattggagtcacgtgaaaacagaactaagtgaattttggagctggtgagctttcttggtgcactatctgtctaccatatttggtggaatccttttctgcagcaatatgatgagaattatgtttcagtgttggccatttgggttataatttttgctttattctaaaacaaatgcagtctattatactaaagcttgcttactttcctttgcctatccttatttcgagttcggggaaatttaagggtggctccttgattgcataaagttaaagtgcaaaaactataaggtggtgtttctttcttctagctggtcttctagttttctgatggcaagctttctcttgcaatgtattgattggctaggaaatcagtgccatcttgtaggctgctgatgctagggtgggagccaatgatatacaactttcaacttgaactggatagagttaaaactctgcggaccagattttctacttaagattaaaattttcttccaatctgactggactgtcattttcttgtgcactttgtttaattatttgctgctttgcagttttgcaatattcaacatcttgattatttgcatttcttttatgcagtttcatgttcgggcctgacatttgtggctcgcagacaaagaagctccatcttatcctttcctaccagggacagaattaccctataaagaaagatttacaatgtgagacagacaagttaacacatgtatacacatttattcttaggcctgatgcctcatacagtattcttgtcgataaccgagagagagattctggaagcatgtatactgattgggatattcttccacctcgaaaaattaaagatgtcaatgctaaaaaggttggtgcttgctctatcatctcgtgctaccatattactgataagtaaggtctacaatctatggcatcgtgatgaacacttattttttctttttacaaaaaaaactaatgttgcagcctaaagactgggatgataaggagtacattgatgatcctgatgatgttgcgccagaggtttccagcagactcaaagaaatgttttccctcctggacgtgcttattcttgttcttactttttatctataccttgtagggatatgattcaattccaaaagaaattcccgatccaaaagctagaaaggtatgctcgttatctttgataatgtaagatgaaattctcacaagcatttggcttggcctgcagagtgatcatatgtgccttcggtaggcttttttttaaaaaaagaatttccaaaggaaaatacattttctggttagtgaggttgaataattttgttacttgccaatcagcctgatacatgggatgatgatgaagatggcatatggagaccaccaaagataccaaatccagcatacaaaggcccatggaaacgcaaggtttgtttgctccactatgtctagttttagtgactgaaatctcacaaatcacaattgactgtagtgatatatgtttcttatctatgacatatattatgaaactacagaagatcaagaatccaaactacaaggggaaatggaaggtcccatggattgacaacccaggtaagctgagaattaaatcagattcattctcttaattatggtaaaaaaggaaggaaatagttctaacaagaaatcccttggcatatgtgatgttcaaatatgttgtggagctttggagcttatctgtgtatatcttgattgcacattaactacattcatatgttcctaaaagcttagttgcttgatatcaaccatatgtcagtctgacattccgagttacttgaaatggtattcaagtgaaagtgttcaaatgcaagattttactttgcaacaaaaaggattttaattggtgctactgcttggcaaaaatacctcagaatcaaagaactaatactgaaaatcatatagtttagttgaaccacttaaaaatatcattattacttttcttcattttgaggcaaataatgaactttagaagaacttcagagtttctattctatttgtattctttctgtgcttaagcatatcagcagagaactaggatagcctctattggttatggtttagtttcaattttcattttcagttaccatttttttatatgcacccatgcgcatgtgtgcttgccttacaatggtagtagcagctgtcatagcatcagcggtattagtgtaagaaatctaagtttaaggtcttggttggatgcatgaacatattatccatgtgtagcctagctgcatggtatgaagtcaatgaacagtcagtatatgggagggaaatttgaagggatcaggagaggaaggagattgtggaccacacgttccctatatttctagggatatagtaaatcacctttttcatttgaattccttattctaattttgaggagtaggggtgtctgcgaccataaccaatccctgcaaactctcctcccatgtatcttgctgctcaacaatgttatcttctgtggggaggttagacatggataatacattcaaagaggccatacatctccacagattttgatattcatggtataataaattttaagagcttgagaagctgaatgcaggcaaaagactttatttttgaactgacctagatcaaggaccgcggaacgagaaccggaatccatgctagccggccagcaatgtggttcagtatgggtccataccggtttgtgctgggctgaaccgatggggcaaagaagaggagagggagaagaaaaagagaaagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtacagccagcccccccccccccgcgtcagaatttgaagatgatccagatctctatgttctgaagcctataaaatatgtagggattgaagtgtggcaggtaaatcactgtagcgttcttgcctaattcttttcactaaagattaacggataatttgccacaaatgtttttaactggacattgatttaaatgatacaaactttaacatgatgatgtaagtacaggtaaaggctggttcagtttttgacaacattttgatatgtgatgacccggagtatgcaaaaatggtagtggaagaaacttgggcgaaaaatagagaggtgggctcacacctttccactgttgctgtaaattgtccttagatttcaacttttaataaatgctataatcttttgctgaaaatttcaggctgagaaagaagcatttgaggaagcagagaaagtaaggaaagctagagaagaggaggtatttattaaagagcagcctactttattcgaaattttttcttgtatatctgcctttcataagcgagtaatgctatggggtgctggtttagttcatataaaagttttctgtcacatggcccagggtattggtgcctctgttgagaattagtgcaagggatgactgagtatatagttgcctggccagcattagtgggtccaaccaactagtcatttgcatgaaaccatcaccgaaagcatttttcttaacaaacgcttggcatttctaagacattatctattctggctctttctgcaggaagctcagcgagcaagggaggaaggtgaacggcggagaagagagagaggatatgatcggcgttaccggggcagggagcggtacaaggatagatatagaaaggtaaatctcaaatctctttttctcatcaaccaagctttacgtgtgccatagtgttcaatttttaattatgttcttttccagagccacatcccaactccaaagaaaaatatcaacactcagctcatcttttggtagcttaatttttgagaggaaacccattgccatcagccaacattgttgtgtttcttaaacatcatcaactttcggtagtcagattaacaaaagtacaatgaatatattctggcatgttcctgattcttccagctacttttgtcctgtctaaaatatcctgaatcattcttgtcttatcagttaaaacttaatttgttggcaaacacgaggcttgggtggctcgttgaattgcagtgcatcttttgtaaaattccaaactgttcgaatttgatgtactggatcttgggtcataccattatcaaaagccatttgtctaagcgaccttcattgtccaaagttgaatgcgagttgcagggtagagtttaagatctgataaacttcacaaacctctaggacttcacagcgaaaatctggacgcatcacatgaaattccaagttgtgttaaacatcaccctcatctcttttgggtccatagaaactcatgactcaactatctttctggtagagatcattagtaaataaaggccagatattttgttcatttcgattctttacttcgcctactgtacgatccaaaagttttaaacatttaagtcctcatgaaattcttataacatcaaaactctgaaagaatcctcaaggctaatgatcttccagctgttaccgctgctaattagaggcgatggttcaataaagcctctaattgtatttcaatgtagattgtagtactttcaccgctaaagctaaatggttttctaatttgaaatctttatgtgcagcgccgcgattatctggatgattatcatgtaagttttcgaaggctggatcagaattattctcatcttgttttagctgcattagcaatttgtctttttggtatgaacattagcaatttatttatcatactaatccctgtatcctaacacgataacaggatgaattgtgaaagccatgcacagttccatcagggagacaatggaaagagacatccatatatctttttgtattgttagtattggggtttgaccgtcgcggactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatgatgatgaggggtccctgaatgaaagttgagtataagttttgttagtgtgcaacaatttatgaagaacttagaatctcttgtcctgcaggttaccatccattggtaaagaccgggtgtaatttggacctctggctgtgctgtgttgtatcagtctctgtactttgcccaacaatggccaaggaaaaatgttgtattgtccacacggtggaaaaatattgttcaaaataaagcttgaatcttggggaaccaggtacttggttgcttaatgaaatcatgacactccaaccttcgtgcttctttttgtttcgtcagcagtatatacgggattttattttatcagacgtccactaaccaaggtttcgtctagggatttctgtagtcgtttcaaactacagccagattgacttgcatacttttctcaaaaaaataaaaaaatgttcaatgttatatgtaacttgcgtccaatgttatctggggaaaagaaacttaaaaaattttggactggagagtttaattttgacctctctgagcctagcaaacatcagggaggaaggttactgaaagtgacatgcacgataaagggctgtccacaagcattttgatcaaggatgttctttcctgacatgaacatgtagatctaacccagcatgaggtcaacttgacgtaacatcgagatgtaccttgactgcatgttttcacgcattcctacatctttttccttacaatattttcaattattaatcctaccattgttgtctgcttataaaatgttgttatatcgtcgtgcttgtattataattatgcataccggtatttaacccgcgcattgcgacggtttaattgatattaataatgataatattttttatattatgaatattaataaatttaaaaattaaaaatactataaaataaatttgtagaatataatttgtaaatatcaaaaataaaatataaattatttgatataaaaaaattattttttttgaattttatcctgacaattctaaagcatgaattcgcagcgtaaagcttagaagtagcaaaagaaaaaaaataaaactcttaaaaaaaaaattgagaaataacaaattagtaagtctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattttctagtataaattatctattttgtattattttttcatcttcttttttttttataatctctttttacgtaaactatacttgaagaatttgttttccctttatatgatggctttaattgcttgtgcgactcttctaataagaatacctttttcaggtaagaggacagccttgcatgtggccgaacatgggaaaacactggtttggaaaacatatattatatagttttgggactctatttttgaggcctatcaagactttgtatggagggtatcatgcatatggtgttgctgggcttttgtgtaatataactaatatggcatcttctttgcaaattgaattggtgagttctcttgtacttttagaccttttctattggatgtcttctatacatgttcagagcaaagctattgaattgttgttgttgttgttgttctttgaactcaaacagactcaatgctgcaacagttcaactaaaaaaattcctttccatgagaagctacatgggaaagttatctttaggacttttggcttcttttattaagtctagaagttaagtcttaacatgtgctttccacattttattccttcctctaaagattcttttaccaaaatcttgtctgttatttctttgtatatatttctgagagatccagttatttgtgcttctcatgcatcatgtaacctgtacagccgtatataaccatctatataatgttggcatcaatgtgttgttttctggatcacaattttagaacatggtttttaagaatggagatatattaaaataagatggggcttggagcatgtgaaattacaaaaagtgtttctttagattgacattatgccaaacatctgactggttcaacttggatactgttaagttccttcagaatatttagtcatccatttgcttctcaaatagttgggttatatatttattcgatgctttgagctagactgtgatgcctaaaccaactgtacgtatccatgatatccatagcaataaggccatttgccatcatgatgtggttggagctgtcactttttgacagtttgtagatgtaggcaaggttttaaatcccataggacaaaagtgtcacggttttctcatggaatgggatgtcccattgtcccatcttattgcaacaacggtcccgatcatgcatcccgatggctatcttttatctctccccttcttctttctttctttctttctttcttttttttctctctcttcttttctttcttttcctctaccttcctttctttccttttctttttcttctccctttttttctctctctgtcctttcattatttacttttcttcatctctccttcctttccttctatcctctttcttcatctcttccggtgtggatgggtttcggtgtcttgagcccatcttgatctcattttcttaggaacggacgggatggatgggacgtcccttgtctcactgggacataaaaccttggatgtaggcatgtgtactgttcatactcattcccccatgtgtatagccatgtcccgggccatgttgaagggcttgatacatgatgaagttcaagcagtcctaatgactctaggatatggttcctaatgatacaactactctgtcatctttatttttcttgatccttagtccatgttgttcatctttatagttctaaatgtcattgcatctcgtctaacaatattgaggttgcattttcacatggtgtagcatgactgatccttgtcaaattgttttgcccaccctgtaatcttgttcctttctaatagcacaacatgctgctaatgtatttttctcttttgatttatttaatgtgatattgttcttttatttgtaaaaataatagttttatataattcttttttctatttctgtgtcacctatgtttacaaaaaaaccatcttggtttcagcttgaggtagttcattgtggtcctcgtaaccttcgttgccatcaagcaactaagaaagcatgtgttcattcttcttatttccacaaaaagttgagctcatactctatccactgtttgcaatgcatatctgatttttcccacccttaatcacatatcctttgtcatcatgtagaataacattgcacaattaacatttgacattgttatcattatatcctttcatattatgagttgcacctgattgtaattccctttttatagaattacttgaatctgtgttaaatatcatcctttgcaacctgctcatatttttttcattcttctggcatcctaggcaaaatttcacttttagtaggtgtaccgttccattattccaaggtttttttccccctttttcaagattgtgggagagacccccttgacccaattatttaaccaattgactatttacacctggaataaatgaggttaaaggagaggagcaggaaacatggtcaacccaccttttactcacttttgcctggttaacctaaataattgggtaaatttactctgtcaaaatggttaaatgggtttatctggttaatccctccatttttggtctgaagttattcatagaacctagtcaacttggtttcatcctcctaacaccaaaagggcctcagagttacatttattttatgtggtgtcttgtcaatcatttggctaaattatctatacatgttttgtacatcaatctgaatagtctaagttgtgtatggcttgttatctaaggtcatccctgagacccagaaacccggaccctagttgaatgcaatctaaaactgtgtacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttggatatttctttgttctgttgattgagcatgactcctgtaacttaggtgtcatatctaaccaaactgttcccacctagagttgaagaatcactcagacagatttgataaatcgacaatcatgtatgcatttatgtatacatgaggggcacaaggttcatgatcaaaacttgaatcaccattttggtttgaaaaatttgaaatgcactctcaatgtttatcttttctttcctcatctattatcgatcaatttttaaatttaaaacaaagatcttcatgccttaagtacaaaacctcccaaatggactatataattttaagccaaaaggtccttgttcgtcacacttagcccgtttggatgccagaacagcttattcctggataagatcttctggttgggttgaggtcttgagaaaataaaatatcgatctatgaaaaatttgagaaattggtagaacttcggaaccgattgtcccgatattttgaggagaagataaatcacctatttctcagagaaagttatccaaacttttaggagtgaaatcattgacaacctccctataatattgggactcttttccagacttactattttgattcttcaaactctcattttgcagataatattcagtgattaggcagtccagcatccaaacaggacctaaagcccttatactactttttaagttctgtttccataagatttctatgaatattcattgaaaatttgccatgacttcttctaattactttatttggctctacaaactctatgacatgaaattttcacctttcttcaattaaaaatttctcacgggcttgaaacatggaaatagcctctccacatgtagtggtatggttgtgtacatctgaccctctccggaccctgcagtggcaggagcctagtgcagctgggctgccctgcttcaattgaaaaacctaacctggtttcagaaatcttataaaattgtcaagctggcatatatttcggggatggtatgcgtgatgcttttgtaaattcttaatcttcaagaatgggcttgtaacgactgtagaaaatctgtttttacaaagtcattctcagtagatagtgctgtctgcttatagttgactgatgcttcatgctcatctcttaaaggtatctagacatggaaaccaatctcaattcatgtattcataatgttaatttcttgtatctttttgctaggtaccctgcctccaagataattatgcatatcttttgcatgacacggatacaggtacggttggagttgtagacccttctgaagctgttcctgttatcaacgcactggaaaggaaaaatcagaacttgacatatatactaaacactcatcatcatcatgatcatactggtggaaacttggagttgaaagcaaggtatggtgcgaaggtacgatgcagttactttattttgattttagaaaagtagcctagatgacaaatttgccttcttgttttctttgaaaacattgtccttcaccacttctatgaaaagagaatgtttatgtcacattttaataattagtttatactctgaagcttttgttctatgtatttaaggatttttgaagtttttaggttctctgcaatttgaccttaatttggtgattcatgtagactagtgatcaatagtgtaccataacaggctgacttttatgtagtagaagtaagctttcaaaattttatgacactggaggtgcttaattgattctatagggacaaatggatggatgattttagttgaaagcattccaagatgttgctttgttgtgggttttcaagtcatcatcagtctatgggactttataatgagcctttatggtcttctcatgtatatgtacagttagaaaagcgataaagctggaaacccttactttttgctggaggctagaagctagaagaaagaaggtcctggtctccagtacttattcaggaaataaattatgaacttaagagtgatctctcatagtgatctggttgtccctctctaagactcatctgtgctccaaacaagggcctgttcaagtttatcttttttccagacctacttattttgttcttgcctttcatgcccattgaaggtttttttaaagaattcaactacatggagactgaagagatgaatattttagagttcacttctggaagaatctacatatttttactttcctaagtatgggctttattatcacatacagtcatgcctagccatactgtatcatgagtctatattcattgaagttggttcaaaataaccttcttttttcaaaaaaaaaaagtaccggacctgtacaaataaagtggtcactcttcatgacatctcttgctcgtggtcctctgtaaataaactttccttcttttggccaactctgtcattctcattctagtgctacagtattatccattatttctgttcaatgtaactgaaattaatttttctatgacacctgttccatattatttcttttaaacacttaagataaatatgtgccatgccttttttgtgggttgctttggtactaaccttgaataggaaatatttagtgtgctaatgacttagcacgcttaccctttgaagagcacgtaaagtatattttgtggtataggagaacaaagtagataatatgtggtttagggttaatctccatggagaaggaggtggtggggtgcgggggtgggctcgggcgtagggtgtgggtgatcggtctgcaaattcctgtagaacatgatactgatgggcttcgtaaggcaaccatcatcatccatagtccatttcattcagtggatgtttctagacggttaacctgttttaccacagtcacacgtccatgtagaaagagaatcgagacaaaaatggatcttgagtaagccttggtgtcgcagaatagcacaggaatgttcccgcatattactttcctgttcagcaaagtaagatgcatgttaaatgtaaacaaatagataaattgttttggggaacttttaagcctttagaatcttgttcagtgacttcatcttctgaatataggtgattggttccagtgaggacagggacagaattccaggcattgacatagcccttcatgatggggaaacatggatgtttgctggtcatcaggtgcttgtgatggaaactcctggtcatacaaaaggtcaaatttataaaaatcacctgaaactaacagatctacctttttcctactcatgtgatatgctgattacctcattagaattgtatataatgcttttcccgctcatggtttaccataaacaaaaataatctattccatgctcctttttttttgtttatactttaggcgtggaagtttcttactaatgattgaatttacttgttcatttgacatggttattttctaaagatcagaattggaaatcactttctttgtaattatgaccctggtaacaatgttttcagttatactcattccttttcttatcttgttctactcttatcatgacttaataaacgtgcacaccctcctccgaattttataacttttcttaagtaatactttcttttgtgcagatatttaaccaaactattctggacatttcttgaaccattttacttaaatttttgaataaccaaaaacaagtagagaacaaggattaatatatactgattagagctgttatatctaggcatgtagcatacataataaatatgccatatattcttctaatccaaaccttactttcttgaatcttaaacaggtcatttaagttattactttctgggatgtggagcaatatttacaggggacattttgtttagcttatcgtgtggtaaactttttgaaggaaacccagaacaggtttttcactgaactcagaattttttgtttgcaatgaccgattctatcccaataatgacactcatctgctgaagatctgacttggttgtttgagtaaactaacctctgtttctgtgccctaaagtataatagacagacttaaatatggtgcatgcatataatattagaatcatgttatcattccaagaaatgaagttcatagtgtgcacaactttagttagtgagtagacctatgtgcattctacatgggccttacttttacacacaaaaaatgttaaaaggtgtcaacataaacgtgcaatatatatttatgcttgtgagttcgtataaatatgtctgtggatgtgcacagctgcttgcacaggtcttggtttggtgtttgttccactggttcatgcataggaattaaaatttggaaagctatctgtacttcctattgctccatccgaaattttatttcgggcacaatcatcagtggctcagatctgcttgtgggaaaactcaaagctcctgattctgacaacattcaaagttcaaactcatttgcaggttctgaaaaaaaggttgcaagagatctaattatttcaatatataacaaatttatcttcatttgcacaatgaggtgttatataaggataatcaacagtcattatataatggtatcttatatatagtttcagcagatttttctataataagaatctgtaaaatttctcatgctgcagatgttttcttcacttcaaaagattatgtcgttgccagatgagacaaacatatattgcggccatgaatatacactggtatgcaattctgtaggtctgtaagtagcacactatgttctgcttatccgaatatgttttggctttacttctgacagaacacatggtttacttaaatttgaacagagtaatctacagtttgccttgtccatagagcccaataatgaagcacttcaagaatatgcgacacatgtagctcacctccatagtaagaagctgccaacggtaactactagaatctcctaaagttattgatttgagtgtgattaaagatacatgatttgcactgtttctgtgaatccacatggtgatctcgtaatttgattgagtaaaaggcatttaataaagtacaatttcaaagtgaaaactagctattcttctgatttactcagattctgaccaagaattttctgtatatatcttagattccaactacactaaagaaggaaaagctttgtaatccatttctgcgcacctccagtccagaaatccgacagaacttgaaaatcccatctactgcaagtgatgcgcaagccttgggtgtcatccaccaagcaaaggataacttttaaggcagtgctcatgcttgacttaacacaggtttgtattatttcaagagaaacaaatatatgtatattgcctttttgtaatatgcccaatcaattcctttagtgccgatagttcacattgtcgggcacctggtgaaatgcccctccagttccaatctcatccagagttatattcgttttgcacactgccaatgtgctacactgcaataaagaagtatcaggatttatgtatggcatcattcttgttataacatcaccttttgcaacacccacttgtgctatcaaggattgtcggtggaaaaaaggacaaggatcatatttatattcagatcatgtcaatataatcactatggtgtttcttgctatcagtttttcctggcaaaggaaaattttgagatgcctgaagagcaaatgaagctatgatagaacattctaaagttatatttagggatttttgcagtaaaaatagactctattttcttcatttgcagaagagacagatttatttattatttatatattatcgatttatttatttttgcagaaacagtgagcagtaggtgaatgcacacattttatttagttggtgtacaagtgtattggatgcagacgtgacagaagttgaggcacatttaaaaatgctcttgcaaataatagcaagagcaaaggtattacaatttcacaaattttttaaaaatggaagcaaattctggcttttatgcaaatttgacaattaagttgatttttgtgcataatttatttatattaataactcagatatattctctctctctctctctctctctctctctctctctctggttgttgttgttgtggtggtggtctgggggccttagcgtggagggatgggacgggtggcactcatagataaactcttagttccatgaggagctggtcatttgttgatcgttcaataattctatactattgaaattcccgtcagcttgaataaagttgttgtttgaactctgtggagattcctttgagttcatgtgtttgccgttgactccatgtggcagaggcttataaagacatttttgctgaggcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctgatttgctaggaatggttctaatctgaacttgatttcccagctgagctcagtataagcatactgaaccctatgcagccatttaacgttaaccaatagttctaaatgttgggtctatgcagaaaagttaaatccacctgcacataatcagttggattggattcagtctagcctatcaagtgaatagtccagatcttggtcaggatgaaccccaagcacatttgatcaacttggacaggaaaaaggcaataaggaaaccccccaccacacacacgcacaacccaaaaaaaaaacacaccatctaaatctaaagcaacaatcttccatcatcttctctccaacacaacatccagaattttccttataggaatccacactgtgccatacacctgcaatcctttctttttattatattgtattgtgccaaatacatgagaactagtgtgtagttgtaacatttaaatatcaaacataagatctcttcttggttaataaaggtgtgcaaccaaaacttatcccaaatgaagtttttgttatataacagcattactgaagttatgattttgtagttcaatttttattttacagacacaagattggacaagtaggcccttgcttgatgacaaaagtggaaaaataaaagaaattttgtttgaattcaaaaatttgtgtacatttgaagtgtaccttacagtgatacaagtgtttgacttttatggtgtcatatagatagcatttacagatgaaactaatgcatgcatgtgtacatgatctccactttcatttctgatagttggaaaatcatggtcattgccgaaacttgaacttattaaaaaaggagagcacagttaaaattattatctaaactacatatttctatccgtaccccttttgttgtaacttccatgtcccatcacgaagcacagataaaggctctttaatcttttttcactctatatttatagaatgaatttagcttgattctttttcagatggaaatgattatatacaattaacagcaggcctacaattcatcttcctgtcaagcttgtcttgcttgctgttgtgctggccaatgaagttcgcgagaagctgggctttggcgtaatagccagtccactattttctcctgcaatcatttccactctctcatgctcgaggactttcaattgttctgaagctaaaaggctgattggatactcaccaattatatccttggaggtgagtatgctttctgattcttcttctactgcaaaatattcatgttttgattctttatttctttggcttggtgttcactaatgtactctcaaatcatgttattagtgcccacttaaggaagcaagtgggtgggttatgtttacaacatttctttcttaaattcaaacttctttttttgttttgtttactttttagaactttttaaaggacatgcattaaaatgcctagttcttttctaactcacatgtccttagaaatatcaccttttgacagaagtgtttaaataatttgtggtcattgattttgtgttagtaacataaattttgaccctctcattggatgaaaaatttatactttttatatttgattggtgtatttacaggatggtgttacgataactctggaatcattctcacaattagctaaaggctcggcatattcaaagaagcaagattttaccaccccttcaaaagcagataaactgttaggaagtggagtaggtgggaccaatagcttcatctaaacattcttctttttttctacctacagggggtttttggtttactccatgactaatttaaaataagaaaataacgtaaaggatctaacaattaccagcaccatttttttggttatgctgtaggtttgggacattatgatgtgttcctttcatatgatggctgttgatatctgttttcagttctttaattaacttcgaattttgtcgtattgcagttgctgatatattgctgtggcgagatgaacggaagacttttacatatatcctttcatcttatctgctgttttactggttcctcctgtctggaagaacttttatctcatcaactgccaaaatcctattgctggttgcagtcattctctttgtccatggctttctaccttcatccatgtaggcatcactgttaactaaattctgtatggtgctttagaaataacttctagtaatagtggaactattttgctcattcttgccttaaatgctagcatgttcagtatttccagttaccattacatgtatttataagattaaatgcaatgagttatttgtcattgtgttatactttgttcggaaagtccaagccataagtaaaataacagagagcgctcttacatttgccaatatgcctaaagcaaccagaggttgcttagttcttctaaaggcatcttattggtcatttattttctgtttcatttgatatatggaattgcagatttttgtgatggtgatgagatattgtagaattcaatcactttggtggtgtggcaaaccaacagatgtttgtctttattcagacagcaaaaggaatcaacagacatttgtcaccattcagatttcagacagcacccaccaacagcaccacctgcaagtcagaaaacatcaatttagttgtacatagctctgaacaagccaacctgcatgaattcatgaaaacccacatgcctatttgatccactacacagtcctcccaaatcaatgagatactagataaaccccttttatctccaccatcctttttgacttcatcaaatatgacctccacccttttgtgctttttcaagatgctcttgttcttcctgtctccaagtggaccacccaattacaaaaggataaaagagctatttcctatgttcatcagatctaaccagccatgcagacaatctctagttaggaggctctacaagaaatttatgaagaagtcttaaatgtatcctgtttctagcatcttctcttcaccacagtaagattgacaatggggatttgatcacacataagggcctgtggtcttaacctttcagactgttgggtagatctgaaaccaatgcattgtctcaccccattgccaaatggatggcacttcctcctctaacagcagtccacacttcatttttttgggtgtgcttgcatttacatagaacgtgagtgcatttatttagtcctaactcctaacaactaaacattgatcatcataacttgtgtaggttattcttatagttactataaatgcaatctttattttatagctgagccgatcaatctttagtatttcttatagcccataaatatggtacattcctgtatataatgtaggcatcctgattacatttttttctacaggtttggtttcaatctgcagaagatgccttcatcttactttcaagtctcagaatcaactgtgagacaatcatttatcaccatggcagctccatggaacaaagtaatttctctgttgaagttactagcccaaggcgatgactggaacattttcttcaaggttagaggaatgaccagaatttcttggtgtgtacttgtgattactttcttattcttgctagcttgcattttagaacttcaccttgtacattagagcatgaattgtgcttttcctttaaaaccatgctttgtttatgtatcagaatccctccgctgggatgatccagaggtaggccaacagaattgtgcagaatctgtttggactgaccatttggtggtttaaatgctgcaaaaccacaaatcaaatcaaacctttcttatattgttattgacaaatttttaatatggatcagtcaattgaattggcaagaaacctcacgggagattattgttggtttttaggattttgaatgttatagatgtgcggaatctcaagttatatagctttgtatagcttaacatgtgtcttgcagcacgcatgtgagatagaggggtgagacctgtatcattttttgtatgatcctctagttgctacctatatttccagaatacattatcatcataacttaatgtactatagatgtattattttatgtttatttcaaaatttatgtttacatgtcctccaacctacactatcaccatcatcatatcctcctactccaacattcattacatttatcctccctcttccttgtcctcaccaggccctccacgccctgcctattttaggtgctttcatttgttggaggtgaatagcggaggaagtggagggttgcaaaaggagttggctgggtaggctctatagtgttggtgagatgagttgctgggagccatttgcttgcaggttgccagccatggtgaggcaaagcagctagctgaaatgattcatgttttgttatctgaaggagagaagtggcatgattagatgagggaagaggaagagggaagtgggaacggggaatgtacacacttcagtttgctagatctttcttggtgcaatggatgttggaacgctaagtttagcccctctatcctagtaacagtatattagcccatctttcttttcgtccatcatgcgcggtcatggatggattgagattgatgtccacacactcatttgccacaattttggaatcgagagcgtgcttagactctgaacagagccaaacatccgacttctacaccttcacatggagccattgccatttttagggttctcaaaatgctgttctgctagaatttatattaccaccacattaacttgtacgagtgttgttttagtacttcattaagatatgatttttccatgtaaaaaaatattaggctaatttcctgtgcaaggagacaatgaatgtggtgaatgtctaggtcaagattttaagttttgaccaaaattgatctgtttcagctgaatttcagccaggaccgaaccaaaactgtctttcactttcaaattttgatcagtttcagccaaaactggctggttttgtccaactttggtgatttctgacagttgcagccgaaactgtcagagactaacaataaatgtcacttttatattttattttggcaattagaataatgttggggttatctctttgctatgtatgtagataagccatatttcaattaagagaaaggatagataataaatatgaactttgacaagccaaggactcctagaagattcttaccatggcactttataaagacaattgtgatttgtgaagaactaattaagagacatttcacagcaataatatcttttttttatatataaaataaacatgatgctctaaaaatggcattcatttgatcaaatagccacttgatctaaaaaaatatttaagatgcctattctaataaaaaattgaagggatatgaatgcaataggcattaaaaagcttcatagtttcttaatataatgactttttgaattaattgaatgtcaataagtgaaaaatgtatacgtctgtatgatgcttaaattcaattaattatatgcaatattagtttcggtctataatttgacagaactatgcaaacagggaacctatataacacaaaatgctgtaaactgttgcataacttttcttgttttcttttcttctccttcgattttttttgaattttttatgactttagatcgaaaatctgaaacttggagcaaaacttacaaaatcactgaaactgccaaaatggaaactttatggagccagctgaaactgaaatcaagaccaagttttcaaaccttggttaaagtgtacttgaatgtatttgttagcattgatgttatcatttgttaattcataactaaattgttgcaggcggctggttttttatgtgtgatcaagttgcttttgcctttttcactatcggcattgattggtgttggtaaggattcaaattgaagctaccactaatttccatatgcaattactatttcaacatggtcagttttttcaccccttttaccatcaacacaggtttgacatgcttgtttagcctcttcataatatatgaacaatgcgaagaggaggttgacaaactagtatcaactgtatctgctggaatgaggaagttgaaggtaacgatggttgctaatctacctagtttcttgatgatgtatttgcaagagttaaaaaattgaggacgactgcttagggcctccaatatagcaccacgaaagtcattcacttgctgttggatatcaattgatcagctctggtaagtgttcttcatgggaagagggtactcgtagagttattaatttaagcatgttaatttaagcatatttatttgagcatattaatctaagcatattacaggaggtacctgataatcagctattagttcatcatgcatgagttatttgtcattgtacacttgattcacaataccaatgaatttcaacattaccagcttttatacattcttcgtcaagcttagggttgctgggctcatgtccttgagagtataactttttttgagaactaggataagaaaaagtggggttgaaatccggtgatgggactttaacccagtttgctgctatcaacaactagtgactttaccagctcagcctgtcagtgtcgtcattgttcagattatagttattttaagtgtcaatgttgtctatatccctatgctagtcgcaagcttcataggtcagtgttcttaattgtacagatggcttgcatttttgtttgtttttctagcatgcttatctagtgataatggtaaataaaaaaaaggtgaatatttgttacagtagatttaaggggagagcatctataaaggtaacagggcttgaccatgctctgcaggagctggaagaatagtaatatggaaacatgtggcaaccttagaaaatgaaattgactaactgttcaggctgatgcctgtagcgtgtcctatttgaggaattaactcatggcctttctatcctaccagaaaaggtgactgcctatgcaatatatgtgcatttgctttttcacttatataaattattttttgggactagtctaatgatgccatattaattgttttattgttatctagattcagattggaaggaaaagcagaaaaatatcttactttttatttttttttacctagtttatgtcaccttagtgcctgttattgatggcagaaagaataacgtctatactgtaggagaatgtggaaatgcttttagcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggagttgcttgtgagattttattaggtcctccaaatggagcaacctcgtatttgaatagatttttctttcttttggcttccttatgagaaatgaaacaacccacttcatgatcttgcaaagctttgcatggaatccaatgaatcgaagcaatgcatatctagcatggggaaaaaatctaactcctcttatacgacaataagcaccaataacatatactttgtatagtagaaagtatatgctctaacatacaaggaaaataatccttctatattacatgttagaaattatctccactttcctcttcacagatggaatgtaggagttacaccttatcataagcaacacagcccaagttcgcaaatcaaatccaatcacctgcaatgattatacgataaccaactctaccttaagataacctaatccataaccctgcaaaatatgtgtagcgcatgaactctgcgggactagaccgggggttcatcgaacccagccaaattctatccaaataaatcaggtggggccctggcctggcgagaaattattggatgcaccaggcgcaagtgaaccagggcaatgcacggtggagggcgtgcaatcgggaattgctgcaaatacaaggggtagcgtggcgtgttatccaccgtgggatttgacgcggtccaatagcaactggtgcatgcaacatgaggcctggcggtgccttgacaaaagcccgccatagaaggcagcaaacagtttcacggtatggtcgacgcacacagaaacagcgtatataagaaacaggacacgtcttcctaccccgtgccctaggcagcgacatctcttttttctcttctactatcctctcggcagctgcccctccgccccgttcttcttctcaccgccctagggtttcttacccgttcctacgccccctctcttgccccctttggatcctcgaatcggcctcccgcatcaaaatctctggaagatctcctcctttccggggttctccaatcccgattgcatccctccaacgccgtttcttgcggatttcttggccagatctgttatagggcttttgcaccgccgatgccttcaaataaatcggttggagggtcgtcggaccaccaccggcggatgctttccaaggaagggaacgacgatgaccccccgtcgagcgttctctgggtggggaacctctcgccggacaccatcgatctcgatgtcatgacggccttttccaagttcggcgcattggactgcaacacgatgcatggggccaggagctactcgttcgtgttcttccggagcattgaggatgccaaggctgcgaaggatgccctccagggttccacgcttcacgggaataccgtcaggattgagtttgcccgaccggtttgtccctccccttcgtgtaatctgatatgcattttgcttagattgatggaagaatgcatctttcttctcctctttcttctcctctgctgtgttgcttatgtgttaatttctgtgggcagattgtggggatggattccaaaaatgcattctgggttaggttttacttgtttccgattaggacacgtttcttcattgtttgtctttcttggttttgtatctggttattagcgtggcaaaaaaaggaaaaagaaaaacggatagaagatttgataaacgagacaatgtggtgatcttttctaagtaccgagacagaattttaggaaccatatatctcatctgaaagaatcttattaaattaaaatttttgtggatgattccttttttttttggattggatttttttttccttttgattaggttgttctgggcctgatttttttttaactcttctgattagtatttggttattaacaaggaaggttgatacagtatagcaacttctgtactatcttatcaaacagtttctttaataaaatgccatcactgtgtttttttttggtcagttaaatgatctttgtggctagttagacattgactgatgtagtcatttgagccaaatttgtaaaggggatgcatcaaacactgggagtagttagaattggcactttgattctgtcaagtgcatgatatttgcagtcctcgtcacgtaggaattatgcagtcttgttaggtttggaccactaggaacagacacacacatatacacatgcaaaggtggatgacattaaaatgatagtgtcttgtaaagcatattcatgttttcatggattataccctcgtacatgatgcggatccctgtgataaaggatattacatggcaattaacaaatgtttcaatcatgaacagaggtgccttttgcatttgcaaaagataaaatcatcgcaccgaagcaagcaagtttaggagctggtgtttttgattcaccttttttttggttcattttgtttgctcactgtctagttatttcagttttaacagatgacgtggaatttaaatacctcttaacattgctggacagtttttatggaatatttgaatgcaggaaccataagaatttggttttgcttttgtgaattctccaaaaatatattccttatagtaggctagtaaagaacttggaaagttgctaattgaaatgtggctaactctacaaacatcgacaattttgtttgtgtgcagacttctatcaggttgtatagtttacattactaaaggtggatgaggtggtgcaagtttttcgtgccaattaagatttcaaattcatcatattttgtagattgatgtaaaggagggagaaatcattcaggataaatgtttttgctttgtactttcaaaatgattgcaaaaaatttacattcttacaaggcaaattgaagatagcctatttacttcaaagagtaaagtctagtcaatttgtacatggatgatagatgtagggggttgagagcagttgtgcttgcaaagaaacagatggggcgatgggctaggtgtgcaccagccaatgtcccatgaatatgtccacctaggtgagcatcagcttgaccaatacatggggcagttggccattggtagtaagctaaattgcttccatcaataacaccaattgagatagagggaatataggatgttttgtatctcgtgcatgttcaataaatgtggggtttgaccactctctgagtcctatgtaaattcttttaactgttgaattctgatccattacttgtaaggtaatggtattgttttggatttctagttagttctatttagttcctaatgctgagcaccacatcatttgaaacacatgtagttttattattgttttagttttcccctaaattgaccatatgttggccaaatgacctatgatagactgatggtttgttatgagtcacaattgagatgcctctgaattagtcaaattgttttaagtgaatgaaatcattgttaactatttggactagggttaaggtggttaactctctttaagttgttaaaaaacaaattcctctctcaacttgacctttctagagtaattcatgcttgcggaatgaagctcttttattgacaactcaaactgctgttagcaatttgaatccccttcacctttatgcacggataacttctacaatgtggaactgttttatttaccatatagttagcaatgttattctcatgcctaatgtagtcatcgagaacatcttattttgaggtaattgttttcttcttggatggtaagggtaggccagtgcatgaggctttcgccattgtggggtctggacgtgcacaaccttatccccgcatgcggagaggctgtttacgtattttgaacttgtgagttgtgacgtccgagtcacaatagagtaactttaccattgtgccaaggttcactgtcttattggatggtagtggacaataaagtagcatatgtttcatcttagtgtttgctgtgccttcagattttaattatggtttctaatttgaaagaaacttggttgtaaggctcaggcatacccataaaggttgagaggatcaaatggttctaagttgtttgttgtttaccattctatttatctttcttagctaagttgctataagatgaatatttttttatttttcatttcaaaccttatcttgcaaatggaaccacatttcaagcatcacaggctgctcttggacataccagcaagaatagagagcttgagaggaattaattcaaaggaataattgctgctaagcaatctgggggaggggggggggcaaactcggattcgcttgatgacaatagttcaaggtgattgaaagtagttatcctgcgaagccaaaaaggataaggttgtaattgctgagttatggtatgctaagaacgtgcaagatattgtgagcatcgtgattggcggtggcaagcaatatactattacaatgttgttgagattcgacagattgagcaagaaagattgtttgttcatttagttgggtgtttaattgcatgtagcaaaagcaaaattgttcatttagttggatggttaattgtatgtagcaaaagcaaaattgttaatcatcaataagatgttcaaatgtgcaagtaacctgttggctaattcctatttgtgtgctacagcacctaagtggccagatgtcctggagtgacaaatgcctaacctgtagcataggtagctttgcaagtacctgtcgaatttcttaggcaactaatttcgctgcttgagcttcatttaattattattaaattttgccttatatttgatgatgcaatgatatacatccttgaagtcaaaccccatacataaatatatatgtcatacgcgcgtgcatatatatacatatatgtgtatacatacatccacacatgcacacacacacacacatgtatgtatacatacatatgtatatatgtatatgtgtgtgtgtgtgtgggggggggggggggagggaagatatgtatgtgttcggcattttaagaatatgtgtgtgtgtgtgtgtgtgggaaggaagatatgtatgtgttcggcattttaagaatatataagaattaataaaattcatacaaatagataatgacaagtgaaaatcaataactaatagataaaaattcaggaaaaatagaaaactgtattataattttacacttatatgagcctactttgatattctaggatgttaaactggaaatgctgatattttcccaaataatgcttaaacttcagatatgccataactaggtttacactttctgttcagcaaacaagatgtataatatttaatctattaatgttcaaaaagaaacacaaacttgttcttgagggagcaacttatcaaaaagccatttttatcacagcttatatgcaccatagccacatatgtgagccatgggctgtttagttgcttgttagttcattgtaggcctacccaagtgtgatgtggtcaccaagctgcaggtgcatagatggcttcccagacactgcactttaacacacacatataatcggtgacatatatgattgttgttccaacttaaacgttaatgattctatatcttttttggtcatccaacttaccagcagttggttcttgggtctaatgtttttatgtgaagtgagaaacgtttatagctgactctaaaaaatataaattatgctacaaacacacaataacatataggttatgtatgaacctgaaatgggatatattacgctcactaacataaagttgtacatagataaacacatataatagcgggtggctaatgaaattatttttttaatgttgccagcttgcctaggtatgtgcctagaaggctagaactttcttagcacctgcacctgatgggttaaattgtaattgcctaggcaatctatggcccttctgtagggtaggcagttgtccaagccccaaggaggcatctcctaatcagaataatgagaatagtgacataacatgtataattcattttatggtttcatttgacaacttcaactacgtgctgtgttttggtgatcctatcagagcatgatgctgcagctagtgtttagtgtcatgccttttttctcgtgatgttcataaaaaataacaaatcatatctcaaaggaataaaagtttttgatgtttctgtaaataacaagcctgcatttttctccattcaaaaaaggaaaaaaatgaagctgcgtgatatagtttaaatttgaaaatcgtaaaaaatcctcatgtattattaaaggttgcgttgcggaggttgggtatttttccttgtgcatgccactcaatgtgtgcacaacatggcactgaatggccatgtggcttgctcaacttgtgccagtatacgtagcgtaagagatgtaaaatccctggttttaaatccactttacagtatctatctattgtcacaatttgctgtttgatccttttacatacattatgtgagtttttctatttcgatcataattttggaaaccattttgctgtcagcaacaagtcacagggatttcacatcctgtgggagtggatgattgctgattttgtgggatgtgtatgagatttatcgatctcagtagcaatatacccaattctgagcagattaaatactttgtttgcctgcttatcaccagttaccttttacacctggtgtaatggtattcagttaaactatataatctttaccactccatcctgcatggtaaaagtgctgttcagaacaatatgaatataaacctgtatattattgtttaaaaaccaatcatttgtgaaactaaaaaaaggtagcatattgagtcaaattgcatattatattgacatcacattgttataggcctgatatgtttctttgccaactcgctgacattatatttggatgatcgttggcatattttggatcatactgagacatcacatgctacttggttcacgatttgcacaagatatgatatgtaaagccaaaatgcatatgagttttaataaggccatgtttactgttgaaaatgtggcaaaaaccctgtttagtttttcgcataattgttttggacatcagagtgctgcattagatatcatgttcttggtttatcattaattctggagaatattagtttcaatgctgagtcactaatcactttatccttatttatgttagtatttggaatgctgttctgctaccttaacatgtatgcatgtctacatatttatgtatacatttatatatgtggacacacttaacatccttgtctatattgatgtttgggtatggtagcttgaaagaatcaagagtgttgcaactttttgtgtttgatgaggtcaatgcaattcagttacattatgcatttagttctgttgagttttgtaaatactatacctgctgcatgttcataagcctaaagtactaagtacatagaaaagaaaaagtgagagtagtcatgtgcagcctaagcttattgaccttcacttgtaattgtgcttttaaaaggtcacgaatcaactaaatatgaattgttgcaaaagaaagatcttcatttttggtgttatgtttaattatatttgattgctggtaatcaatttttccatcctttctttgttataatctgctacaagttaaaacttcaagtctgatttctaattacaggcagtctgatttatatgctttagtaaatcaaatttgaacatagaaataattacaggcagattaagtttgggatttcatgcattcttcgatgctttcatccttttcatgcctttcctaattaatctttttacactagaaatacgtacctgaccccatatagatgagaccggacccattgattatggcatcttgttttcctcttaagatcaagttaatgtgtatataatgatataatgatatgttaaagaacaaaagggtcatggttgaatattttcttctaggtctcacagtcatttgcagtgaaaaatgacatacagaagggtgctgaaaattttcttttaatttttggtttcaggcaaaggcggttaagcatttatggattggaggaatcagttcatctgtcacaaaggaacaacttgaggacgaacttttgaagtttgggaagattgaagagtacaaattcctcagggatcgaaatgcggcacttattgactattacaagacagaagatgccattgctgctcagaaaaatatgaatggaaagcgtttaggtggtgaacaattatgtgtagattttcagagatcccagcctcctagaaaggtgtgtggttagtcatcacactggtttttccatgtttaatattgctggcatgcctgttatccgatatatatatataaattaaagttttagtgacttttttttgtgtgcattctattgttgccctgataccattatcatcatgactataggattggcctgactatcgagactcaaggaatggacacttaggcaatcggagtttggggctgcaggaacgatcgctgccacctgatgcaagaagtttccatgattcttcctatcatgggcttaagaggcatatggtatatatcttgaactagaaagttaaactcctgcaggatatttcatgacatgttttgatctgcatgttttaccctgttattgtcaattgaacatcggattagaagtttactaatttatggactgtttcgtgttttgtatttgttgaaaatttctcagcctcatggaggacgaagagataaccatcctagtaatgttctctggattggctatccaccttcagtacagatggatgagcagaagcttcataatgccatgattctgtttggtgagattgaaagaatcaagtgctttccctcaaggaactactcttttgttgaattcagaagcattgatgaagctaggcgtgccaaggaaggtctccaagggcgcctttttaatgacccacgaatacagatactgttttcaaacagtgagcttgcgcctggtaaggataatccaccaccatttccagggtttagagggcctagaccagagatgttctttaatgaaggacctattggacctttggaattgtatggtcctagtcgtccaatggccccaaatagtttttcgggatccttgcttcataacaacatgcctggatccagtattttaatgaggccatttggaccacaaggatttgatcctcatcatggaggtccagagttccatgattttggtggcactgctatgcctcctacttggggacgacgatctccgtctgcaccgggtattcttccttcgccaccagccttgcgccctcctttccgacccatgcctggtttacgggatgaattcgacattagagatgtgaagaggtccaggacggacggttcttcgactgatagtgctttcttgcatgcaaggagggtggatggcgagggtattggagatccctttgggttttctcatcccgacagaggtgcattcagtcaaagtcgtctcagtccagttcttcatggccatggtgaacttcatccttctcctgatagtgaccattgttggcgtggtattattgccaaaggtggaactcccgtttgccatgctcggtgcgtggcagtaggaaagggcgttgactctcctttgtaagttttgactctccccaacccatgcatgattaactttataaacataattggttatacattatgataattgttataaaagtaatcgattatctattatgatgattgtcatatgaacttctttggcaggcctgaagttgttaactgctcagccagaacgggattggatatgcttacaaagcactatgctgatgctattggctttgacattgtcttctttttgcctgacagtgaagaggattttgcttcttacactgaatttctccgttacctgggcttaaaaagtcgtgctggggttgcaaagcttgatgatgggactactctatttttggtgcctccgtcagattttttgaccaaggtattgaatatttctggtcctgagcgtctatatggtgttgttctgaaattgccacagcaatcaactaatgctgtggtaccacaactggcaattcctccgccatcccattacattgatcagcaagaggcatctagttcactgaagggttatcagtttgttccacaaaatgaagagcaagcttcaaaaatggattataatcggtcattgtatgaggagtcaatgcatcgtgcaggtgttgggaaatcacttctgacccatgctgatgaaccacgtgccctgcaaccagcttccctggattatgctggtaattctgctgctgcttcccaggtggaggtttccttgactcctgaactaatagctactttagcttctttgattcccagcaacaatccatcatcagctgctgcgactgcgcaaatgccagtctccacgggcagggcagctttgtcttctgcttctgtgatacatgatgcttcaacgccttctcaagggtggagacaggaacaagcggcagcttctagtgcttccttagagcaaccaagccatcttccacagcatttaggtcaacaatttagtagtcaggcaccactcaactctcattttccggcgtatcctaacattccaagtggacaagatccttctacacaacctattgttggtagtacacaaattcagaaccctgctctaaacatgccagaggctccatttattccgactagaccttcaaataattatacaatgccaccacaaggtggccaatttgctggcacccagagcaatcaacagtatcagttcgattcttctttgacttctcacagcaactatggcatgttacagacaacaaatgcggctggtgtgttcaaccaaccagttcagcagcagttaagacccacttcatctgctcatgatcacactggaaatctgccccagccccaaagtgccattccgcctactcaagggcaacacccacaacctgttctgtctggttcaggtcagggtacatcagatggtgatgctgataagaaccaaaggtaccagtcaacccttcagtttgctgccagcttactcctgcaacttcaacaacagcagcaagcgagcgctcaagctgtgcaaggacctggaaatcaacattgaaaaatgttcttatgtgacaggtattcttttcacctcgatttcattgatttaataatatgttgaactttctttcttagtttagtggtattcctaaatgcgattacatgagtatctgttagatgcatgtagttaattatttgttcttccttttaattgtgcttgcagaaatactattatgacattaatataacaggaacatgtttttttaacaagtttcactgataaatcctaaatacttctgatgattgacatattatattgatgatagaaatcttaaagctcttctgtcttttattgagtatttataataactttcatagtcttgaagtacaggctattgttggttttctatgagcatgtttcttcttcccccctttttcttgtctaatgctgaaaagcagtagaaatattatgattcataatgaagcaaagtaggtcaatctaagcgtttgtcagatttatgagatctatgattatttcactgtcatcttcaattgtttttaaattataactttgtgattattcagtatttggagcaaatttctattcttgattcatttcatttggttgattttggagattagaggaaattatggtctggatgtatccgattgcactgttatcagcattctgttggagaatgagtcacatgccacctgtaataaaaccaacctaatagtagattatgtaatgccttttggttgtttttgcaatagtaggttatataacatttttctgttgcattttatggtattaagtttggggaaaaaggaatagctatcatctttatagtgggaagctagaagttccatcagatggtttgtgggtaaagcgggcataaagttgatgataatttgatatgatgctggaatttatgaaaccataaagtttacaaaagcataaaatgtttgtagtcattaaatgtttcattacatcatcatcatcatcatcatcatcattatcattcatcattataggatttgagaagaaaaacattgttgtacaaaacaaaaagttcataggaaaaaataagattgtaacacttgagttagttttttagtgctctagaatttgtccaagaattaatgagctgacaaatatctgtgaggtgaaatgacactgtcaaactcttgaaagctatatcataaaacttctaaattgattagcaatgtaaaatttgggatgttggtttctggcgtaattaattacaatatgcaacttgattttatcttggattagttatatctgccttccgaagtttggtctttggatattgtttctttcgagttatggtgatgatgattattgaagtgcttagtgcactcgggacaggttgtatctttcgagcgaaaggagggatttaccttccttcgcatgaatccaccattggatcccaagatggtagcttcctgatctgtgcaggatatctgtgcatgactgcgatccaatggtcgatgtcatgaaagaagatcaatcattctttcgtgtggaatatataacctgaacccagtacacggtgaaattggtggatattgagtctttttacgttaagaaataaagacatttgtaggtgcgaatcaatcattgttgaaatgctgagtcctataaagcatgcttacttcacaggactaactaaaatgtatttgtggcaattgagatagaattttgactaaatactcaataaaaataatttacatgataatttcctcatattcttatccccgacaatgaggggcgcacaagattcctcattgtgaatttctcagccatattacatctggagtcatctttacaagagaggaattaaagatgaaaaagcacggtcaaatatttaaactggcctttgtccttggataagtgagaaacctaggtaagaacttcgtttttcctttgtctccttaagtgatttagattttttctctctattttgaaatgttgcaatgttctatttttgttttttatatgtataaatgtaagacaacgaagttcaaaatggaggtgttgctgcaaaaaaaatttgaagaactgtctttcatgctgatccttttgcttcgttatcattatttttcttgacgtgcttaaaccggtcgcctcagtgtcaaatcttaatagagaaatcaaccttgtcaatgagtgcgcccgtataacttttatatccttttcttcaagttgttaaggctgttcagaatgcctctttttttggttgaaccgtaccaaatcagaaatcaatcttgaaccataggcttttaaattggaatgaagtgttagtttgcggctggtttgaggaactcctgccgtccaaagaattaggaacgtgttagaagcaagaggctgggttccctttggaaccctaactcaaagggaggagtgttttgggggcgtgcgattttatccccctgctgttatctccgatggacttgaggaaccaaggaaactagaggcaatcggactagggactttgcttttgcgattttagttcccgctctaatctccgatggatacgaggaatcccatcaaatagaggaaaccagaggtaattagattaggaactctaccctttcaacttgctgtcatcctcgtttcctctatctgatacttttatagtatggatattctgccacgctaacaggagcaatgtagaatcaacatgaagcatggaggtccgcatgcttgggtaacatctctctgggcgaagctttattgatcagagaggctatttacaaacacgtttgcgaaagttatgcgcttgtcatgaggagagccctatgagtcaaccgaccgtttttttgtctaaatttgttttggatcatacagataagcagttggaccactttaaattttgttattatttcttcaaaaggcatcttagtctataatggatttgttggtctctaaaaggtatatcagctcagaaaggattccgatatttgacatgaataatgagtttagttataaaatattattttgaaacataaaatatttaagatatctttatttggctagggcaacgcatggaacacatgaccttaagctaatcataatgtttctggtgaattccctcttttcgaaggatcaaacaaatatttaagatttagcaaatccatgtttccctgtttaaagtgggaattatatttaaaatgtataaaaagctgctcccctaaaaggtgttgaaacgttgttgaggcctggatgtaatagtactgcagatattaattttagaatctggagttggattttgatatgccatcttgttagattcactttatgcagcaatttgtttgggtataaagcttgcataaagattccaagcttatgcttgccaaatggtcaatggaaaccagtaaaacctaggaatggttgtgttgatatgatagccatatttaatccttggggaagctgagataaactagcccttgtcataaaagtttatacttattttttgcttttttatagataaatatccctagtttaaaagagaaccctagtttaaaagttattctaaaaatggtagccaaacaaaaattggaacaatttctagtgtaactattcccatcgtaggcataagttttgctatttttatctttttctcgatccaaatccagcctaatagttaagtcaaggcaccccaatgtgcttgtaccgaaggtttctttttttgggggaaagaagtctgtggtatgtaaagttaaaagacgcctgtgatatggaagattgctagggcataattattgggggattctatggtcctctcgtctttgtgcatctgggacctcccagacaaatgctttttttttagttttctaacttatgattatgtactttctgtagaaactcatatgtactatatagtggtaaatttctagattgttaaattttttctgcctggtgctacaacaatggtgccttaaaagattgtattgcaaaagtggttctcataaaatggttatgtgctagtgggatggtaagagggcatagtactacatggacctatgtagggtaattgtgaagctggaattacactaaataatagtggtaaagttggtttgtactggttagacggaaaaaaggttgatttagtccacactgtttaggcagttggaaatgaggtcattggcaacctttgtctgttgtgtataaggccaacgtcatattctagagctggttagtatcttaagtaaaagttcttgaccagtaaggccggaagagtggtaaattttctttaagaggcttcaaattgttgtttgaacttgagttaggagaggcaggcaagaggaggaaagctataatcagttgtgaaataggacaggaatgtagtcttgaaaggcaaggagagatactcacaaaagatgaacttaatgaattttgattatcatcactatgggattgcatggcaagagatacttgagacctcgaggggaggttttaggagtacaggacttattgactagtcgaaagaggtaaagttcaaaggagttgggatggattttgaattgaattaatagttatgtgaataaaagaattatggtaatgggcaaaaccttaccagcttgaattttgcaatgatatgtatggattttgatagacaattagatatcaagttcggtgtgttcatatttatattataagtacaagaacatttgaaggaaagtgttaacattgtagcatcaaattatagaaacaattatatttgcaggtattctttttattcttttttttgtattgcccgacatcctatttcaggaacatgaggaaagtagggaagcgccaatgccttttatctcatagtgtgtttgacaagatatttgttttatgttgactttcatgttaccttccgtttagatagtaagaaagtactcgcatggttacttgtatctagctttgcttttggaattgatgaactataagatagtattgctatccattatttgagcctttaaggagattcgatatatgaagactggtgctacttccaataagcaatatttactgactatccgtgctttttggcattcttgtcacttcaaaggattaggatattaggatggaagttgtgacactcgtccatatcctaacgattcattgtagccggtggtgcctatgaaaagaagggaggtcttgttggctaaatcacccaagcaaagagttgtaggagttctctagtggaatactactctccattcttccatgctctctctttctcttgtgggcttctctcctctctcttcgagacttttagcttgagaggctggggtaatagattgacttagaggttgttgcgggtaggcaaatcaagtgctgcatggatgcttgatgagatttcaagcatgtgatagttgatattatagccaacttgtgggaaggagcatcatggcttctgaagctaccactatgcataaggtggctgagcaaaggaggctgtggggaagaagggcaaaggaggctgagacaagtttcgtgatcaggggagctgcatgaaggtaaaggttgccaagtcgagatggttgtgattgatacaagagattggtttgacgagttggagcaaggcttgaaggtgcttcatgatgactttgagaggcaggttaaggaactctataaggacatgctaagcatcgtgaactctgttgggaaagctcaatgtcaagagaatctcacattccaatcccaagttctagaggccttgacaaacctttaagctttgtttgaggagatgaagagcatgaaggagaccaaggctgattaggccatatgcaaaaaggtcatggctaatggggttgttgctgctcctattgcaagtttcactcaaaaggttgaagctcacaaagccaaggagtatgatggcaaaagggatgccaagaaaattgacaacttcgcatggcacatggagagacactttgaggcactctacatggaggatgaaaagttcaaggtgggaatggccactcgcttttctattgttcttgatgctgtgtggtggcataggaaacatttgagatggagagaggtgccagcttcattgacaccggggatgatctacaatgagaactaagaaacaattctacattgagaatgtcattgatgaagcatggaagaaaatgaaggagctgaagttgaaggggtcgatttgagactgtgctatcccccccccacccccccccaaaaaaaacatgctttgaattcttagtatgtgggctgcaactgagttataggtgtggtgtgaaggacatctcaattgcctctcatggttgtgaaaaccttagtggagttcgtaaggtcgagtttccagatgaaacaattccatgccaaatatgggggagcaaagtggtttgaaccatcttatagcaaggaggattgctcgaagagtaaactcccaaagggtggaggcaagccaccaaagggcaagaaggtggacaggggaaggagacccggaagcaactatttcttatgcgatgatctgcattgggctagggcttgtctagagagggtagcactcaatgccatgatcaaagagcatgaaagctaggaaagtgctcagatgagttttctttgactcgtcaatgtcttgaaggctaatctagtgcccaaagctatgggaggtaggaccttgatgtatgtcgagatcggcatcaatggcatgcccgcccatgtgatagcagacatgggtgcgacacaactttatcaagccagattagtccaagcagcttgggcttgagctgatcaaggagaaaggctgcttgaagatggtgaattctaaagccaagccttttgatggtgtaatttgtgggggtggagttgcaccttggtacttggagtggcaaagctgacttcatagtggtggtttttgttgacttcgatgtggtggtttgcatggagttcttgaggtagttcaatatggtgctcttgccttgatacaactttatactcattcttgaaggaggtaccaccatagtgccaacaatgaccaaacccaatttaggtaccaagcttctttttacgatgcaagcaaggatgtgaagaagtcatgtacttggctattttgaaggactatggtgggtggtaaggactttagagaatttcctaagaagattcgaggagtccttgaagggttcatagatgtcatgttgctcaagtagccaaagagcttccaccatggagggaggtgaatagagatgggcaatgggctgtgcctggtatggcacggtccaggcccacgggccgaaggtttaacgggtcgtgtctggcatggcttgtttaaacaaaatccttggcctggcacggccttaggcccaggggtggcaggccgtgccaggcatggcccgttggcctattaggcccgcgggcctttttttaataaaatttttaaaatataaaaataaaaaatattaagtaataaaaatatatgagagatagaagatataaaatgaaaaaattgcatcttcaatccattaatattcataatattaatgcatattaaaattaaaaaatttaaaaaagaaaaaattgaaaaaatcaatgaatgatgaatttcttcaaaaaattaaaagcaggagaactctattttttagaattattaaaaggatcaaatgatttagaaatatgatgagaatcttgttttgcacgaggactataattaggagcccataacggatataaacgggcatgttaagggggcgggctagcatgtgggcggggtcgtgtttgacccgacgtcgtgctagcccaagcccttatgggctgtgcctggcttgagctgcaaaacccccagtccagctcagcccccttatatgtgctgtgcctaacacgatccgttactgtagcaagtgggccgtgccaattcatgctgagtcgggccgtgtaatgggcggccctgtccggtgcccatgtctagaggtgaatcataagattgagttggaattgggagctacactacctgcaaaggtgccttatataatggccctgcctgagttagaggagcttaaaaggcagctcaagaagcttttggatgcaggatttattcagccttttgaagcccctcatgatgccttagtgctctttcagaagaagcacgatggaagctttcgtttgtgtgtcggctattgtgctcttaacaaggtggctatgaagaataagttcccaattcctctgattgcaaactctttgaccagcttggtaaagcatgatacttctccaaattgtatcttcagttcgtgtattggcaagtctaattacagaaggagatgaaggcaaaattacctacatgatgaggtatggggcatttgagttcatggtgatgccttttaggttgaccaacaccccagctacatttagcaccttaatgaacaagttattccacaactacctcgacgagtttgtagtggtgtatttggatggcatcatcatatacaactagatgttggaggagcatgtggagcacttacaggccattttcacaattttgcagtttccttctacatgcctttttgcctgggaagagattgaattcttgggtcatcgtgttgctagcagcatgatttgcatggacaaggaggccaatgctatctaggaatagcaggctcctaccaaaaggatagagttgtggtcattcttgaggcttgtgaactattatagaaggttcattatgggttatgcatgttgagctggacccttaatggagttgcttaagagggattgatcgttggattggtttcctaattgacaggaggcttccaaggatttgaaggcgatagtgatgtaggaaccagtgctatggctatctgatcataatttaccatttgaagtctatacagatgcctcagattttgttattgggggagttcttgtgcaagaaggccatgtggtggctttttgagtgctggaagctaaatgacatggagaggcggtactccattcatgataaggagaatgtagtggtagttcactgcttgagggtgtggagacactaccttttcaattaggattgacaacgttgctctcagctacctcgagacacaaaaaaagactcttcaaaacaagctcattggtgggacttcttggcagaatttgacatggctttggagtactagccggggcatatgaaccaaattgtcaatgccttgagctacaaggctaaacttgctacgatcagccagcttaaaggagatttgctcaacctaataaaggagggcatagagcacatgatacatcggccaatggattggtggacttacttgatgatgagagaaccaagcaattttgggtggaggacggcctgctacttacaaaagggtgctgcattttcattctaaggtgaggtaacttgcggaggaacataattaaagattataaagcaggtcggagactcaagacaacactataatagggcctcggtggaggcgacatacttttggccacaaatgtaggtgaaactcttatgtgaggatttgtcttgtttgccagcaaaaggtggagacacaagttctaatcgagttgctagaaccactattcattttcgagtgaccattggaaaatgtttgcatggacttcatcatcaccgtacctaaattcgaggggtatggatcgattattgtggtggttgatcggtcctccaaatacactattcatacctacccctaaagattgtacagtagaggagatggcttgattgttcttcaagcatgcatcgaagtcttagggattgccacaatagatcatcagagattgtgattcacgattcactggtatttttggacctagttcaaattgacgggcttagtgctgcacttctccacaagtttccaccccaaattatcattcaaaccaaaagggtcagcgagctactgaaggtatacttgatgtactttaagggggtgcttggttggggggagtgggaggtctggaatcggaatcggaatggatgactcccattccaactatttggctgggaggagtcccatttcgattccaattccggagtggaataggaatggctcaatctatgtagaactcaatccctactcttctttatggattcaaatttctattccaatttcgattctgatcacgaaccaagcgcttcgggggatttggccattctgatttcgattctgattccaattcattttgatatctattccgatttcgattttgattccggttgcgaaccaagcatcctctaaatgctaatcaataggattgggccaagctacttgcctcaattctcctacaatctacagaagatcgaggcgaccagttggagcccattggatttagctgtcggacaacaaacacatagacacccaatactttagttgccagctacatgagatcaagtctagcagctcttaaggtagcaaaatcttggcacgagcaagcagatgtagcatgttgttgtcttgacaaggctctcaagagaatgaaaagtgggcggataggaagaggaggttgctagagatgaaagtggaggactaagtgattgtaaaaatattgccctcacaatagaaggctacttgcaagttacacaatggccttatttgttgtaatgaatggccattccccattccgaggaaggtgggcaaggtggcctacaaggctataaggtggagttaccttccaagattaagattcactccttccatgtacattgaaaccctactatggagagctagatgaccttggtcgaggtgaatccaagagagcttcgtcgggcatcctaacatcctatgacaaggaggtggaatatatattggcggactgtgtggtgtgatggagcggtatacctcctagttgggaatatttggtgaaatggagaggactgctcgatagtgaaataagttgggaacctattgaagtgttgtggcaattttaggagctagtctaagaatttcataaaggcatgatgagggcatcaaggacttaagtggggaagaatgtaacagctcaagccttccatgcaacattgggtgcactgattctttattgagaggagctcgatgggattaagcttgcggaattctctagacctacaaatttagtagaatggcatgatatttttctaggctcttatggaaagagctagggggattttaatcgttgaaattgtgacatttgcatgtattcaaactactagttgtagttggtagtgcctatgaaaagaggggaggcctcattggccaaatcatccaaccaaagagttgtaagagttatcttctactgctaatccattcttctaatctctctctctctctctctctctctatatatatatatatatatatatatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctctctctctctctctctatatatatatatatatatatatatatatggagttttagcttgagaggctagggtatgagattgacttagaggcgattgcgggtaataggcttagaggctagggtaataggctaacttagaggaggttgtgggcaagcaaaacttctaagcgtttcacaagtgcttgtagaaattccaagcccatgacattagtgtcatctaaatttcttcttcttcatcttctttctttctctgtcttcgttttttgggggggggggggggcggattgttacattttatgccaatttgcaagtcaattcattataaatcattttaaaggtgtgaccttccatggagctatgtatttcacaactttgctaggattctaaatgaataagatttgaaatggagttggaatctaatcctatgatgagctagatgcttggtcctactagaattttaatctttgcaagtcattaatgcgccactgtagggacttcaaagctttgagaggatgtcttagtttaaaaaatggaaccttaaaaggatccaaaaaaattattagtgtggatgggcagatgaattgtgtcaaaggtttggaagatatcctaaggtatcctgcctatttgaaatctatgcaaatctttagataaaattgaatgatggataaacttttatcatgtaaataatgttcttttaaggtgcttactaccaattcttgtaatacttttgcttactaaaaacattaacagtaattaagaatgtattttctaatactaatcttggcaaattgggttcattactaccatcaggtttactactaaatagccaaattttcaaactagaatttgaactagcgaacccgtgaataacatagggcttgctgtaatagtcatacccagttgctagcaactagaggttttggcttcattcttggatggtgcatctcttgaagttaggatgtgagtaattatattgttggcaggttctctcccaaaacgttcatggttttctttcttttcatctaaatatttcgatatgtggtcatgttatgaagacacttggcatgagtgccaagagtgttgagtattttaagtgttggatacggcaatctccaaaaaattaggcacaaggaaacttggcatgggcgtcaaagagtactgagtgttgtgagtgttggatatgacatacctctgaaaacctagagtaatatatattgtatacatgcacacttgcactgtttccgttttgattgaaaaagcgcttaaaatgaaaggagttattgattctacgtaacaaacaaattaaaaagaacaaccatgagtttggatatattgagatactggaatactagttaaccattatacatttgttttaaaaaataatgatatttttcttaaataattatatattatgatgattttaattgaaaatatgattatacttttggatagacaagtcatgagggccaaggttgataagttgcatttctgatggaggccatttgtttgtagaatattttgataatttttatagtgtttcagtatttttattctgtaaaatagtctggtaggttctatttttgttcacaaattacttggttgatggttttttttttttttaatgaactcttggaattcttgatcctgaagagcattttccaggttctggctctagtttcagctctagttcacggttcttaggttggacatccttcaaaacgttataactcaaaactctgatgcaaggtgtacctgtcatgtttataatcaggataaaacattagggtcgtttagcgaagtaatgtaaggtgatgcattacttatgctggtcacagggcatgtcaatgtggtgatcgtgtcttggagaatagtgtgatcggttaggtgtgcacgaccttgtaatccaaagcattgtgcattagagccttcaccaatctagcaaattcttgacatctgatctgattaatatacggttacattttgaatcaaaagttcagaacatttttctgagatggtaaaggttgagggctcggtgggacttgatttaaacattatgcttcatgtggctggcgcaatgcgatacccggcagctttgcatttcaacgtgctgcgttgcccgtagcgggctttacgtttcggagattgcgtaccgccgtgcgaggtatttttacagcgtgatgggcaaccatgtcacttccgtagcatttgatgagaattttgacgctctttcgagttgtccttcgatttccaaattggtcgtggtgggacgtcgagtttgtcggctagcatgctgaatggtcccttatttcacttccgtagcatttgatgagaattttgacgcattgtccttcaatttccaaattggtggtggtgatgagaatgcccaactggtgacgggatgtaaaaaagtttagattgtcgactactgttcttagttaaataattgatttttagttttatctctggagtattggaacaaatttgaacgaccgaccatcagaagcgcaaaagggggttcatctttgatttccatctggttccacgggagtttggttgcgatttttgcgtctagggatttttttttgggtcgtagagttgcaaggctaattaaactatagtgatatcatcacaccaaaaagacactatagcattatcatagccatccatagtctggcaggtttgagaaatgttttaggacaacatatttaatattatcgttggaacgttgtatcgcttcctttattcttgtaattctaaaaggattgctcctcctaattgaaggagtatcaactacaaagcatcatggggcaaaatatattttggatttttgaataaatttacctcgttttgaagatccaccgtgcaatactgataatatttggaaccgttagagagtgtctctccggcacgttagagagtgtttgtgtcctggctgtttaacttgttaagaagacttctttctgcaggaattttcccgttggaaacctacgcttgaataaatgtcgtgttatcatcaaataaataaataaataaatggcttgtgtctatccagtcgctgtcaagtttacccatctattattgtgatgtcttcgtaggtgaagcttggagttattttcaccatattcctactggtggggacgtggaagcagtctattgtcgtggtttgctaatgtgttggaaccggaaatgggagtgcgatctaccttctaccgtgcagcccaaagtcgagagaggacgaatgcatcatgaacgccttgttgttttctttaccaaaaacaactgaattagtaagcagagagagatgtatcgtaaggacaaagggagcctatctgatgatgtggttttaggttaatatgaaccgaacatccgtctcagaatctgtatggtggtaattgcagttgccttaagtgctgttggtaatagtacttgttatattcattgcttttttaatatatatgtatatagtttttctaccgtctaaaatgaaaaatcgtatttctcaatggtgggatttgaattcaggtatttggtaataacttaccaatagattttaccacgaagtaatattcattgattacttatttatttaggtatttcaccgaggggagagtggagtcggtttcgaaaacgatgggctgttttatcttgcctggctggggcccgggcgggttagcgttggattgcttagagcatccattagttcatggagaaattctgtgtgtaccgcgtggtacggaatctgtgcactgtgtacggtgattggttcggactggacagcggtgtagaattttttttttttatttggttctgcgtataagtcaatcaccgcatgtgagtttgatgcataaagaatttctttagttcctgatcgaacctgtgactgttttctttgcacaagggtgcaccactgattgggcttggcccgtatttaatgagcccaacttgccgtgggatgggacttcggagctaacgacggtctggtctaacaacatcaacccaaacttagacttcgacgttgcttgaagaaagctacctgcccctagcctaataagttaatagttatttatctgcttcgtaagcaaataaatttgcaaaatttaatagatggtattgagattgttatggaggttatccatctttcgatccgacattctcctctttaggttataactgagcaatcactaatgactcattaagactatcttggagagtcaagaagcgaaagctgaatgatctcatgccatcgattcctatcaagactatcttggagagtcaagaagcgaaagctgaatgatctcatgccatcgattcctatccaaactttggcttaaacgactaccgacttcaaagtcaggatccaatcgatgataaaaaatgaggctcaatgacctccatggataccgagacattcgaggcaaagcctcgattttgccccgatctcaagccgccagcctactcacccactaggcgattcttgcaatcttccaatagcttttcaaacatgagcataatccacagttgatatctacgtctaacaatcttgattcataggttagtaggcggacttcctattctaaaggcctattagattaaggcctaacaatctagggattgggagccaaatggcctcctagactccagcgtaacaatctacggctctacctctatataaagagataacaaagggatcctcaagttagctcaactccggactccatcccaacgactgtggacttctcttgcaggttctcactttggcacctcgatcctcgatccacattcaacctcagccacattagcatcgaactggagttttgcagaaatatattagtgttagatgaagggtgaagtccactaaaaaaaaaagagaagatggcaaaaatgagagcgcacaactccaccgcctcctgttatggtaggtttacagccgtatgatatcctggttcagcagattcaagtgttggccaatgccgtatagcggctccaacagatgatggagtggcatccctcctcggagtcagcttcttggcacagctaccgatctcgccccaaagtctgggattagcccctgacgagcccaccacatcactcctgctctgctctctgccggtcaccttcctatcagagcttgaggaaggaagactagtgatggtgacctcccacctcctccaacagacgctcggctctaggttaccccatagaccaaaaagcctcttcgagaagatctcaaagtgaaaagttcgggatatcgagtgctgccttgacgaggtctagaatgggagtcactagaacgatgaagagaataacaaccaaccaatagttgatgtcatcaatatgatctccgactttttagggggtaggggataaaagaccgagtagacgaggtgaagagagtgcataaggaatattgttgatcttcgaagagctcaaacttttcaacatgatgctgttatcatatcaataataatagtaaattgaaaacttcgatataacttctattcttcggacatggaatgctgagaacatgaggatgtcttattagtaagctgtgtatccattgattatattaataaaaattaagcttttacataggtttcttgttgaagtgaccaagtaaaaagcctgactaaaggtgatcgtacccgactacaaatgaaatcgtcagaaggcaccgaagacatctcaagaagacatccaaaatataaactcgagacaagtggatcaagcctcatcccttcacatagccacctgacgctcgttcacagacaactcgagtagaagctgaggatgacagcgatggagctaatcctctgaagacctctcatagctagtcggcacttctgattcttggacgagtcgagtggaggccaccgacaatgatgaaggagctaatcctccgaggatccctttggccacttagtgctctttgtctagggatgagtcgagcagaggctgaggatgacgacgatggggctaactcttcgaggacattacatagcaatctagtgctcctcatccacagatgagtcgagtggagactaaagacaacgataaagaggctaatcctccgaagaacccacatggctacctgacgcttctcatccacaaacgagtcgaatgaaggtcgaggatgacgacgaagggggtaaccctctggagacccctgatggccacctagtgctccttgtctaatgacgagtcgagtagaggttgatgatgacgatgaagggactgccccttcaggaatcccacatggctatctggtgctcctcatctatggatgagtcaagcagaggtcgagaatgataatgaaggggctaatcctctagggaccccttatggccacctggtgctttccatccacagacgagtcgagtggaggccgaggatgacgatgatggggctaactcttcgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacatactgtttatgttatgtccctgatgcgagtttgcgagctaaggatcatgacagctgccgcatactcatggatactttctccacaagcatacaaagcatctcatcaatcatcatgctatcataaagcaacagcagaacaattagtcaataaattaagtctaaaatttaattaattaaaatctaagtttaatatcccataaaattcaataatattcaaatgatcttacattaactttaataaaatttcaatctaaaataaaagtatcaaaattctacttctaattactctcccatatatatttttgtgtcatcttaattctcaagatctataaaaataataaaatatggggtaatgagttcaacaacccaataaacaatgatcactttaactagattaaattagataataaagtaaataataatttataaaaaataagcatatataattcatcagttcgaaattaatttctattatacagcattatcaaaatattatttatgccaaattcaatccctttcaaaattcacatttcgttcataaaattaatcttttaaaatattaaattctcatcaaccataagctatgaccatcttatccctatagcaagatgatcatattgcgtatcatcttactataagctatgtatcatcttgcggtaaatgtttaggaactgcatatcatcttacgatgagttgcatgtcatcttgcagtatgctatgcatcatttagtagtaaagtcttgatgaaccacgaatctgctgatggtttgtgcgaatctactggcaacatgtggctatctatatgcgaaataaatctttcggactaataattgtcatcgtattagcctcaattgacaggatcctccacatggttaagcagagagttcaagtcatctcgaatcaaaactcttttcacaaatcatatttaatattttagttcgataaaaatacacataatcatgtagtatcgaaattaatcaaatgtaatgcttaacaagatcaatactttcaatcattttttatcataatatttcagaataagatatattcaattcatacattatgaacagtatgattcaaaaattattgatataacaatcttataatttatcaataatctaagaaaagtaaagcactatttatctcatacgtatttcaaataaatctcaataatttcataattcttttttcaaaatcttcaattaatagattgtcataatatcccactacccgatatcttcttatcaagatgatcacatccctatatagaatcgagtccaacattagaaagagtatgaataagtatgaaaatgcatattgatggtggtcatatccaacgatttgggtttgtctagttatccttacttcatcgatcaagattaggctgggataaagatggttcaacaaagatcaaggatgatcaaatcaatagtgttcaataaaaatcaaagaagaggtcaatatgccattcaatgattatagatcgacttaatcaagtaattttatctaatcaaagtcagctaagatacaaaaactcaatagatatcaataaagatcggattttatgatgttcgatgaagacttggataatgcaaatctgttgtctaattgacaaggtgtttagagtttggctattggagcaaatcgtattcaaaatgattggccagaaatccttcattaagtttataaattaagtgaagagagaagagcagagaataaaaaaattaacgagatacaatagaactgatctggcaatactgcccgacaatttgatcaatctatttcagatgatttaatcaaatcatgaccgaattaccatacagatgattcaataaaaatcatagatgatcaaatctagtggtacatgatctgactaagatgagtgccagtatgatgcttagaaaccacagatcaggaccccttcatcaaaatcagtaaaatttatcaaaataaaattctttactagatcaatcttataaagtaaacttctagagattgacataattttagaggaaaatccataaaaaaaacaaacagtctagagaaaaaattttagagaaagaaaatagagagacaaattagagagagaaatagtggaaaaagaagagctaggaaagagagagatttttctttttctttctttttctttctttccttttcttttcttccttttttcttccttcttcttcctcacattttgggggtgaagcaggggatttcatttgaatccctttctccccaaacccaaggggagccatgccaagaaaggaaggctgaggatgcagcctatgatggtgcagccatagatctccggtccagtgctcaatggcaattgatggtgttagaaatcaaggaaacacagacggcaaaaatagggcatccactttccaactaaatttgataaattgtcgattgaaacttatttttcaaaggctataaaaaaaagggagggggttaatcaacgagggccgactttgtacctaattttctgacaatttttggcctgtgatttcgatgaactcaatgaaaaatcatgaggagaagaagaaaaaaaagataactttttcgatgatgataggaggctagagttggtgggtttcaaagagaggcttggcccctttttaaataaggctggggggaggagttgtgtcctccccggctttgattaccatcaagagatcctgaggaagaggaccattgatgggagtccaattcctcccactgatgcacgtgctggccaaattttttttaatgctgcttcaatatctgtgcaaaggcctcgttgggccctttttctatggggttaggctcctataggctagggtggtatagtttatctaatagtcactcatcaagaaaaaataaatttataccctatgttaaattatctaggatattcttattttattttattaatttttcttagtgaatgacatgtttatcatcatggagtagtttatatgagaaggaataacatagaaacgaaaatattggttaaaatcatatgattatagatctagatgttggtaaaaagaaataatcctctctttaaaaatccaaatggagttcattaggtgccttttttttcattcagcaagattgatcatgtaccacttgaaaaatatcatattagcaattataagtgcaacaacctattacatttataactagatggaattcacatcaaaatatgaaaacaaaaagtaacacttactaggactagtccactatttttcttataaggaaataggcttctagtttctaatactaaaattcctatttttaaaaggtctcgaaatccaagtgcagtggctttaatgaagatacattagtttttcacagaatattgatcactaattgtctatattttgatacgctcacaacatacctttgcataaatgctatataaactttttaaaacgatacatcataaataacattgcattatatgttcttaaatgcttttgccaaagagtgctcacccatctctccttaattttagccaatggataagggtattaaagatcatttctcaaaagtatcttgtcgataaaaattgctctagcagttaaccttcatttcaagtgtatcatggtgctctagcattcataaaatcaattagattgatatagactaatgcatattactactcaaatccttattgataatacttaaataatgcgccaattcaatttgccatcattgatttatataatttcattattctatctcttttaaaatatttgcatcagataaaataatgggatacatatatagatatatatccatatgcatgtttagattctatcctccactcgctcactgactctctctccccccccaaaatatacaaatatgcacaatagtatcttttgtatttataatagacatctcctcaatttaaaataaaatctctcaagtttcaaaattttcaaaatgatcccaaaagttagttaagtaatttaatatattttcatcatccatctgtagcaccaccattgaacatcaataggttaaattctttaggagataaattattatacttaataattgtaaaattctatcgaacatcaaaatgcggaaaaattttattattgatatcatcattagaagataggaggagataatgtcactatatttatacatattagaccataaggaacgatgcaaccaaaggaacgactatctaaatagcctacatagcttaccatatctgactgatgaggaatagcatggtgttagagttcagatggtgcccagtgagatgcacccttaagagagcctttatttcggcaagggagctaattgaagtgactttgaggccctatgagacctaggattcccatcctacccttacagcgacttgatggatatttatttcctgagagcccccacctctagcatttctcaaagtcaattttgatggtagcgtcagagacaaaagtggtggtgctggcttcgtgatttgaggatgtggttccgacctaatagcggcaggggggagccagttgtttgagcctacgatcccagaagcggatctccatgctgcttcgatgggtagtgttgatgctcgatgacttgcatgttgtccatctcattgttaagcgagacttcaccatgattgtgacttagttacagagttgcaggcagggagtcatagctcatcctcttctgcaggacatcaccacttggctgttgtggtgcaccagtcttgccattagacatgtattcgaggaggttaatacaatgaaggactggatagccgcctatgttgctgaacatactggggataccctacggacgagtgtggaggcagtccataggtcatttagggatattttattttctgactcttttggatgtactcacataaaatttatatgaatgatcagtttttagtaaaaaaaaaacaagctaaattaatttgtaccatatgtattaaattatccatcacatgtttattttattttattaattttcttggcgaatgacatgtttaccatcatagtcatagagtagtttgtctgagaaggattaacatatagacaaaaatattggttaaaatcatataattatagatctagatgttggaaaaaaaataatcctctctttaaaaatccaaatggagttcatcatgtgccttttttttaaattcagcaggattgatcatgtattgtttgaaaaatatcatattaacaaatataagcttagcaacctattatatttgtaactaaatggaattcatcaaaatatgaaaacaaaaagtaacacttactaagactagttcaccatgtttcttataaggaaataggcttctagtttctaatagtaaactttcaatttttagaaggtattggcatcttatcaaatattttcatatcctaatacaattttattattttgaccataactttcttattcaagcttaattataggaactcaagttgttttgagaaattaacttaaaggtagatgtagttgaagtagttcgaattcaaaatccatgtacagtggctttgatgaagatacattaatttcttcatagaatagtgatcgctaatagtctgtattctaatacacttacaacatgcattagcttaactactatataaatcttctaaaatgatacaacataaacaatcttgcattatttgttcttaaatgcttttggcaaatagcactcacccatctctccttaagtttagccaatggacaagggcattaaagattatttctaaaaaacatcatgtcgataaaaattgctctagcatttaactttcatttcaagtatatcactgtgctctggcatttataaaatcaattaaattgatatggactaatgcatattacttctcaaatctttattgataacacttaaataatgtgccaattcaatttgctgccatttatgtatataatttctttattctatctcttttaaaatatttgcttcagataaaataagggatatatatatatatatccatatgcacatttggattctctcctctacttgctcacttactctctctcatcctcccaaaatatataatcatgcacaatattatcttttatatttataatagatatcttcccaatttaaaataaaatctctcaaatttcaaaaatttcaaaatgatcccagaagttagttaagtaatttaatataatcccatcatctatctatagcaccaccattgaatatcaatagatcaaattctttaagagataaattatcatccttaacaattgtaaaattctatcaaacatcaaaatgcaaaaaaaaattattattgatatcatcattagaagattggaggagatgatgtcactatgcttatacatatcagaacgatgcaatcagaggaactgctatccaagtagccaacataatttaccatatctgactagtaaggaacatcatgatgttcgagtccagatggtgcccgatgaaattcatcctgataagagcccttattttgataaaagagttgattgaagtgacttggaggccttataagatataagactcccatcctactcctacagtgacttgacagatattcattttctaggaacctccatctccagcattccttaaaatcaattttgatggcagtgtcagagacaagagtgatggtgttggcttcatgattcgaggatctggttttgacctgatggtggctcgaaagagccggttgttcgagccaacgatctcgatagcagatctccatggtgcttgggtggggattgttcatacttcatagtttttgcgtactgactatctcatcattgaggaagcactacaacagaatagggtattagtgatgcaaaaaatttatcgctaataatgaattttcatcgataaaaattattagcgatgaaattattgtcactaatattttatcgtaaataataccatcattgataattttttacgatgaaaaaaattttcgtcatcaataatcgatattaccgatcaaaaaaatttcattattaaatttttttttgaaaactatttacgatgataacttttagtcataaaaaaagataatttatgataaaatattatatcgctaataataaaatgattatttacaatgaatcacattcgttgctattaatttaattaaaattttttataaaaattaaatttaaaaaaatattagcaacataaatttttcatcacaaatatgataatttttgacataaatttttgttactaataaattatgaattatttatgataaaaatatttttactattattaatttaatataaaattttaataattttaaatttattaaaaaaattatttacgatcaatttttcatcgttaatatattttttgacaatcaatattttgttaaaaataattttatcactaaaaatttatatatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaaaagcttcctcttcatgcaaatccaaatttttatccatctctagtcggattggtatgtcatatacacctctaggtgttattctttatacgacatgccaattacctcgatactttagatcattcaaatatattacttattttgcttgagttgctaatatatacggttcattctggtaccatgttcgtgcaaagtttacactaataaagtatggatcgatatgaatatcaatctttttattgctaatatcccaccattcatattaaaataagaatacagaattatcggatccatatttcagttctatgatatctatcagcacaccataatattcaatctcttcttctccttcatatcttatcgtagtaatctcactattctggatctattatttcatctcaagcttccttatgtgaaatctcatttcttcaatgatacaggatgcatagtggttaatccttcgatcggggccacatgttaaattgtacaactcatccgtcgcaccctcttctttattgaaatacttatatttcatctacattataatataaaaaattatgttggttttaataattatttttataattattaaaaataatatattactagtacaacttacaaggtcaccaaatcattttgcaaattttctcctatattgatcatcagcatctatattattctctatatatagtatactcttgtgctcactgcaacaagtcatgatttttaattttacatcgatataaaaaattacttaaaactttaaacaatatgctaagatggtacttagtcaatgaaatctttaatttttttacaattatttagaacgtagaagtgtgtctcggatagctcattcacgtccataaattcatatctccttctaccaataggtcgaatcatttatttaaatatagacagtatcagttcattatcatcccattcacgatctgcgttacgatctgaatgattgaatcttctttcgatatcgtcaagatacatcgagcagaatatgacacactccgtagctacgtatgcttctgctatagacccttcaagccgtactttattacgcacatacttttttagggcacaaaaatctgtaaataaaaataaatttaaattttaaaaatatatttacatcttataactgatatgacaaagtgcatacaatttctttacctttcaataggatacatctatcgataatgtaccagtccgatcaaaagagctttctttgaaagatgaatagccaaatacaccataacatcaaaaagtaatggtaaaaaaaaattttctaacttacaaagaatgagcacgatattcttttcaaacttctcaagttagtcttcaatttttgataatacagttctcgaaagaacactcccaacttaatcaatacagtttgaacatcaccatccaaatagtcacgcataaccacaggaagcaagcattgcatcatcatatgaaagtcatgacttttcataccagagatattaccgtcgttgttgccaacacattatgatacgtttgaagcgtatgtgttagaaaactttacgattttgaactatctacaaaaactcttcttttcctcatcaaacaacgaataacatacaggtggcataaaaaatctatcacctcgatgaactaaatgcaactccgattggatttctattttctgcaattcaagataagcttttgtactatcttttactttttctaggatgttcaatactgtatcgatgatattatcataaatattcttctcaatgtctattacatccagattatgaccaagtagtagctacttccaatatggtagttcgaaaaacatacttcgcttcgtccaattcagctcagcttcaatacactttcgcttgtaagtacccgatattttttcaaattggatattttcaataacttcaagttattctaaaacttctgctctacttaactccttgggtggcagacgtcgatcgaacttaccatcaaagtattgattgtaatgggtcctccaagagtgattactaggtagaaaccgtcgatgaccaatgaagcatatttttcatccatgttttaaatataaggaagatgcatctttgttgcatattggacatattagatatcctttggtgctccatccaggtaagttttcatatgcagaaaaatcatttattggtccataaaattagatcatgcaacttaaaatttttttgactcacagaatcagatgtctgtacttcattttcccatagctccttcaaaacatcgattaactgtcgtagatatacatcaatttcattacctcatgctttcaaatccgaaatcaatagtgatataaaaataaatggttctttcatgtactttcaaggtgacattatatacaactagcatcataggccacatactgtaggaagtactcaaattgccaaaaatgattaaatccatctgtcgctagaccaagacggatattgcacaggtcacctgtaaagtacggatgctttgcatcaaagtctatccacactataaagtccgtcggatggctaagtatattctcctccgaaactcactgctcatgatgtcatcttattttttcagctgtctttgtggacatatacaatctttaaagtcttgaaatcaatgaaaaatatctcaaaatcttttgaggtatcttattttctttcctattatcggttctgtacctaagctcaccgcatttcggacattcagttgcctattcattatccttataaaataatatacagtcatttttgcaagcatgtataggaatatagtcaagtttcaattttcgcatgtatatttttgcttcaaaatatgatttcagaaatctctctccatcgggaagagctgttttaatcaatgtcaaattttgatcaaatgacttctgactccatcgattcacgattttaatatgaagcaattttatcaaaaattctaaacttggagaactttgcacaatttggatagagtggctctcgtgcatccattataagctttgcaaactgtttgaaagtctcttctacctcaagccggatattgtgttcatgattagaattgccttcagatgcgctaatactcatgcatatatttgaacaaatattctgatgtaaatcatgcaatagttcttctataccatcatgttcgataggttcaacagcatcactattatcttcaatatcatcatcatcgcgcacaacttcattcgaatgaccctctccataccatatccagcgactatacttcttgtctataccataacgtagcagatgctcttcaacaaatgttatgtgatgatataccatattgacacatcttttgcatggatactttatccgactagcactgtcagccttatgccgtgcaaactcaataaaatctcaaataccttttcgatattcaggtaaaaaaatatctctgatatttatccaacttttgttgatatccatctaacaacaaacatgaaaaccattaacaataaaaaaattttcagtggtattcgaatcggattcgactcgaatttcgaatcaaatctcgatccggatccagacacggatcattttatacaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcatcataaataattagttatttatgatgagcatttattttttcatcataaaaaaaatttatttacgatgaaaaatttttatcataaataatgagtaattttttattttttaaaatttataattttttaaactatttatgatgaaaatattttcatcataaataatcaagtatttatgataaaattttttatttatctcaaatactcaattatttatgttaaaatattttcatcataaataatctataatttttaaatttttattttttccaaatattggagatgataatattttcatttgaaataatattatttttgatttaaaaataattttcatcataaatacttaaattatttatgatgaaaatattttcatcataaatatttagaaatttaaaattaaaataaatgatatattatttatgatgaaaatatttatcaaaaataataaatatttataatgaaattattttttcattgctaataggtaattatttgtgatgaaaagttatttttattgtaaatattttgttatttatgatcaattttttttcatcataaatacggttagtggcgaccaaaatatttacgttgcaaataattttatcacaaaaatactcttttcttgtggtgaagactctattatgattgtgacctgattacagagctgcaggtggagagtcacagctcaccctcttttgcaaggtatcgtgtcctggctaatgtagtacaccaatcttgctgttaaacatgtcttctgataggctaatatggcagcagactggatgaccatctatattgctaaacacaccagggatatcctatagatgagtgtgggggcgttctctggactgtttagagatattttattttctgactcttttgaaagtattcatataagatttatatgaataattttttttaacaaaaaaagaaaaactaaatttgtactatatatgttcaattatccatgacatatttattttatttattaatttgctttgtgaatgacatatttactgtcatggagtagtttatctgagaaggaataacatataaacaaaaatattggttaaaatcatataattatagatctagatgttgctaaaaaaaataatcctctctttaaaaatccaaatggagttcatcatgtgccttttttttcattcagcgggattgatcatgtacagtttgaaaaatatcatattaacaaatataagcgccgcaacctgttacatttgtaattagatggaattcatcaaaatatggaaataaaaggtaacacttactaggactagttcaccatgtttcttataagaaaataggcttctagtttctaatagtaaaatttaatttttagaaggtatcgacatcttatcaaatattttaatatcctaatattgttttattatttcgaccataacttttttatctgagcttaattataggaactctagatgttttaagacattaagttaaagttagatatagttgaagtagttcaagtttgaaatctaagtgcaccggctttattgaagatatattaattttttcacagaatattggttgctaataatctatattccgatacactcgcaacatgcattagcttgactgctatataaatcttctaaaatggtacaacataaatagtcatgtattatttgttcttaaatacttctgctaaagagcgctcacccatctctccttaagtttagccaatggacaagtgtagtaaagattatttcttaaaagtgtcatgccggtaaaaattgctctagcatttaaccttcatttcaagtgtatcatggtactctagcatttataaaatcatttagattgatatgaactaatgcatatttctactcaaatccttattaataacactttaataatgcgccaattcaatttgccaccatttatgtatataatttcattattctatcacttttaaaatatttgcttcagataaaataagggatacatacatacatacatacatacatacatacatacatacatacatacatacatatatatatatatatccatatgcatgtttagcttctctcctccactcgctcactaactctctctcctcctcccaaaacatacaaacatgcatgatattatcttttatatttataatagacatctcctcaatttaaaataaaatctctcgagtttcaaaaaaatgatcccaaaagttagttaagtaatttaatatagtcccatcatctatctatagcaccaccattgaacatcaataagtcaaattctttaagagataaattatcattcctaacaattgcaaaattctgccaaacgtcaaaatatagaaaaattttattactgatatcatcattagaagataggaggagatgacatcactatgcttatatatattagagcatgaggaacgatgcaactagagggaccactatccaagtagcctacatagcttaccatatctgactagtaagaaatagtgtggtattcgagtccagatggtgctcgacgagattcacgcttgaaagagcccttatttgggcaagtgatctgattgaagtgaccttgaggccctataaaatgtaggactcccatccttctcctatagtgactcgatggatattcattttctaggagccctcacctccagcatttctcaaagtcaattttgatggttgtatcagagacaagagtagtagtgccggctttgtaatttgaggatttggttccaatctgctggcgtcggctagagggagccgggtgttcgagcttacgatcccaggagcagatttctgtgttgcttgaataggaattacttatgctcgacagtttctacatgctgaccacctcatcattaagagagactccgccatggttgtgacatggttacagaactgtaggtggggagtcacagctcatcctcttctgcaggacatggtaatttggctaatgtggtatattagtcttgctattatatatgtcttcagggaggctaacacagtggcagactggatggccacctatattactaaacacatcagggttaccctatgaatgaatgtgaggataatccctggccatttagggatattttattttctaactcttttggatgtattcactcaaaatttatatgaatgatttgttttcagcaaacaaaagaacaaactaaatttgtaccatatatgttaaattatccatatcatgtttattttatttcattaattttcttggtgaatgacatgtttattgtcatggagtagtttatataagaaggactaacatataaacagaaatattggttaaaatcatataattatagatctagatgttggtagaaaaaaataatcctctctttaaaaatccaaatggagttcatcatgtgcctttttttttcattcaatggaattgatcatgtactgtttgcaaaatatcatattaacaaatataaatgcaacaacctattacatttgtaactagatggaattcatcaaagtctgaaaacaaaatgtgacacttactaggactagttcaccatgtttcttataaggaaataggcttctagtttctaatagtaaaatttcaacttttagaaagtatcggcatcttatcaaatattttaatatcctaatacagttttattatttcgatcataactttcttatttgagcttaattataggaactcaagatgttttaagaaattaacttaaagttggatgtagttaaagtagttcgagtttgaaatctaagtgcggcggctttaatgaagatacattaatttcttcatgaaatattggtcgctaatagtccatattctaatatagtcgcaacatgcattaacttaactaccatataaatcttctaaaatgatacaacataaataatcttgcattattcgttcttagatgcttttgccaaaaagtgctcacctatctctccttaagtttagccaatggacaagggtattaaagatcatttctcaaaagtatcatgttagtaaaaaattgctctagcatttaacgttcatgtcaagtgtctcatggtgctctagcatttatgtaatcaatttgatacatatggactaatgcacattaatacttaaatccttattgataatacttaaataatgcaccaattcaatttgccgccatttatgtagataatctaaattttctatctcttttaaaatatttgcttcaaataaaataagggatacatatatagatacatatctacatatgcacgtttagattctctcctctactcgctcactgatcctttctccccctcccgaaacacacaaacatatgcaatattatcttttgtatttataatagacatctcctgattttaaagtaaaatctctatagtttagaaaatttcacaatgatcctgaaagttagtgaagtaatttagtatattccgatcattcagttgtggcaccacaatttaacatcaataggtcaaattgtttaagagat

(The sequence listing continues in the following parts.)

What is claimed is:

1. A method for segregating a plurality of *Elaeis guineensis* (*E. guineensis*) palm plants or seeds into different categories based on predicted shell phenotype, the method comprising:
   (a) predicting the shell phenotype of the palm plants or seeds based on the presence, absence, or number of *pisifera* or *dura* alleles by:
      (i) obtaining the genotype of nucleotide 67 of exon 1 of the SHELL gene, wherein a A to C mutation of nucleotide 67 of exon 1 of the SHELL gene indicates the presence of a *pisifera* allele; or
      (ii) obtaining the genotype of nucleotide 69 of exon 1 of the SHELL gene, wherein a A to T mutation of nucleotide 69 of exon 1 of the SHELL gene indicates the presence of a *pisifera* allele; or
      (iii) obtaining the genotype of nucleotide 70 of exon 1 of the SHELL gene, wherein a C to G mutation of nucleotide 70 of exon 1 of the SHELL gene indicates the presence of a *pisifera* allele; or
      (iv) obtaining the genotype of nucleotide 71 of exon 1 of the SHELL gene, wherein an G to A mutation of nucleotide 71 of exon 1 of the SHELL gene indicates the presence of a *pisifera* allele; or
      (v) obtaining the genotype of nucleotide 110 of exon 1 of the SHELL gene, wherein an T to A mutation of nucleotide 110 of exon 1 of the SHELL gene indicates the presence of a *pisifera* allele; or
      (vi) obtaining the genotype of nucleotide 122 of exon 1 of the SHELL gene, wherein an C to A mutation of nucleotide 122 of exon 1 of the SHELL gene indicates the presence of a *pisifera* allele; or
      (vii) obtaining the genotype of nucleotides 23-37 of exon 1 of the SHELL gene, wherein a 15 base pair deletion mutation corresponding to nucleotides 23-37 of exon 1 of the SHELL gene and causing an in frame deletion of five amino acids at positions 8 to 12 in the translated open reading frame of exon 1, indicates the presence of a *pisifera* allele; and
   (b) segregating the plants or seeds into groups based on the genotype of the nucleotide(s), wherein at least one group only contains one of (i) plants or seeds predicted to have a *tenera* shell phenotype, (ii) plants or seeds predicted to have the *dura* shell phenotype, or (iii) plants or seeds predicted to have the *pisifera* shell phenotype, wherein the presence of one predicted *pisifera* allele and one predicted *dura* allele predicts the *tenera* shell phenotype, wherein the *pisifera* shell phenotype comprises homozygosity of the mutant allele at the nucleotide, or wherein the *dura* shell phenotype comprises homozygosity of the wild-type allele at the nucleotide.

2. The method of claim 1, wherein the palm plants or seeds are generated from (i) an attempted cross between a plant having the *dura* shell phenotype and a plant having the *pisifera* shell phenotype, (ii) selfing of a *tenera* palm, (iii) a cross between two plants having the *tenera* shell phenotype, (iv) a cross between *dura* and *tenera* palms, or (v) a cross between *tenera* and *pisifera* palms.

3. The method of claim 1, wherein the palm plants are less than 5 years old.

4. The method of claim 1, wherein the palm plants or seeds are discarded if the palm plants or seeds do not have a genotype predictive of the *tenera* shell phenotype.

5. The method of claim 1, wherein determining the presence, absence, or number of *pisifera* or *dura* alleles comprises obtaining the genotype of the polymorphic marker corresponding to nucleotide 122 of exon 1 of the SHELL gene, and wherein a mutation relative to wild type of the polymorphic marker indicates the presence of a *pisifera* allele, wherein a C to A mutation of the polymorphic marker corresponding to nucleotide 122 of exon 1 of the SHELL gene indicates the presence of a *pisifera* allele.

6. The method of claim 1, wherein determining the presence, absence, or number of *pisifera* or *dura* alleles comprises obtaining the genotype of nucleotide 34 of exon 1 of the SHELL gene, wherein a G to C mutation of nucleotide 34 of exon 1 of the SHELL gene indicates the presence of a *pisifera* allele.

7. The method of claim 1, wherein the obtaining the genotype of the nucleotide(s) comprises detecting the genotype of the nucleotide(s) by sequencing.

8. The method of claim 7, wherein the presence, absence, or number of *pisifera* or *dura* alleles is determined by detecting SEQ ID NO: 13, SEQ ID NO: 14, SEQ ID NO: 15, SEQ ID NO: 17, SEQ ID NO: 18, SEQ ID NO: 19 or SEQ ID NO: 20.

9. The method of claim 1, further comprising selecting plants or seeds for cultivation if the plants or seeds have a genotype predictive of the *tenera* shell phenotype.

10. The method of claim 1, further comprising selecting plants or seeds for cultivation if the plants or seeds have a genotype predictive of the *dura* shell phenotype.

11. The method of claim 1, further comprising selecting plants or seeds for cultivation if the plants or seeds have a genotype predictive of the *pisifera* shell phenotype.

12. The method of claim 1, wherein the predicting comprises obtaining the genotype of nucleotide 67 of exon 1 of the SHELL gene, wherein an A to C mutation of nucleotide 67 of exon 1 of the SHELL gene indicates the presence of a *pisifera* allele.

13. The method of claim 1, wherein the predicting comprises obtaining the genotype of nucleotide 69 of exon 1 of the SHELL gene, wherein an A to T mutation of nucleotide 69 of exon 1 of the SHELL gene indicates the presence of a *pisifera* allele.

14. The method of claim 1, wherein the predicting comprises obtaining the genotype of nucleotide 70 of exon 1 of the SHELL gene, wherein an C to G mutation of nucleotide 70 of exon 1 of the SHELL gene indicates the presence of a *pisifera* allele.

15. The method of claim 1, wherein the predicting comprises obtaining the genotype of nucleotide 71 of exon 1 of the SHELL gene, wherein an G to A mutation of nucleotide 71 of exon 1 of the SHELL gene indicates the presence of a *pisifera* allele.

16. The method of claim 1, wherein the predicting comprises obtaining the genotype of nucleotide 110 of exon 1 of the SHELL gene, wherein an T to A mutation of nucleotide 110 of exon 1 of the SHELL gene indicates the presence of a *pisifera* allele.

17. The method of claim 1, wherein the predicting comprises obtaining the genotype of nucleotide 122 of exon 1 of the SHELL gene, wherein an C to A mutation of nucleotide 122 of exon 1 of the SHELL gene indicates the presence of a *pisifera* allele.

18. The method of claim 1, wherein the predicting comprises obtaining the genotype of nucleotides 23-37 of exon 1 of the SHELL gene, wherein an C to A mutation of nucleotides 23-37 of exon 1 of the SHELL gene in causing an in frame deletion of five amino acids at positions 8 to 12 of the translated open reading frame of exon 1, indicates the presence of a *pisifera* allele.

\* \* \* \* \*